United States Patent
Ivashuta et al.

(10) Patent No.: US 9,040,774 B2
(45) Date of Patent: May 26, 2015

(54) RECOMBINANT DNA CONSTRUCTS ENCODING RIBONUCLEASE CLEAVAGE BLOCKERS AND METHODS FOR MODULATING EXPRESSION OF A TARGET GENE

(75) Inventors: Sergey I. Ivashuta, Ballwin, MO (US); Barbara E. Wiggins, Chesterfield, MO (US); Yuanji Zhang, Weldon Spring, MO (US)

(73) Assignee: Monsanto Technology LLC, St. Louis, MO (US)

( * ) Notice: Subject to any disclaimer, the term of this patent is extended or adjusted under 35 U.S.C. 154(b) by 393 days.

(21) Appl. No.: 12/999,777

(22) PCT Filed: Jul. 1, 2009

(86) PCT No.: PCT/US2009/049392
§ 371 (c)(1),
(2), (4) Date: Jan. 5, 2011

(87) PCT Pub. No.: WO2010/002984
PCT Pub. Date: Jan. 7, 2010

(65) Prior Publication Data
US 2011/0296555 A1 Dec. 1, 2011

Related U.S. Application Data

(60) Provisional application No. 61/077,244, filed on Jul. 1, 2008.

(51) Int. Cl.
C12N 15/113 (2010.01)
C12N 15/00 (2006.01)
C12N 15/11 (2006.01)
C12N 15/82 (2006.01)

(52) U.S. Cl.
CPC .......... *C12N 15/111* (2013.01); *C12N 15/8216* (2013.01); *C12N 15/8218* (2013.01); *C12N 15/8261* (2013.01); *C12N 2310/141* (2013.01)

(58) Field of Classification Search
None
See application file for complete search history.

(56) References Cited

U.S. PATENT DOCUMENTS

| | | |
|---|---|---|
| 5,004,863 A | 4/1991 | Umbeck |
| 5,015,580 A | 5/1991 | Christou et al. |
| 5,159,135 A | 10/1992 | Umbeck |
| 5,416,011 A | 5/1995 | Hinchee et al. |
| 5,463,174 A | 10/1995 | Moloney et al. |
| 5,500,365 A | 3/1996 | Fischhoff et al. |
| 5,518,908 A | 5/1996 | Corbin et al. |
| 5,538,880 A | 7/1996 | Lundquist et al. |
| 5,550,318 A | 8/1996 | Adams et al. |
| 5,569,834 A | 10/1996 | Hinchee et al. |
| 5,591,616 A | 1/1997 | Hiei et al. |
| 5,633,435 A | 5/1997 | Barry et al. |
| 5,780,708 A | 7/1998 | Lundquist et al. |
| 5,824,877 A | 10/1998 | Hinchee et al. |
| 5,837,848 A | 11/1998 | Ely et al. |
| 5,888,732 A | 3/1999 | Hartley et al. |
| 5,914,451 A | 6/1999 | Martinell et al. |
| 5,981,840 A | 11/1999 | Zhao et al. |
| 6,084,089 A | 7/2000 | Mine et al. |
| 6,118,047 A | 9/2000 | Anderson et al. |
| 6,140,078 A | 10/2000 | Sanders et al. |
| 6,153,812 A | 11/2000 | Fry et al. |
| 6,160,208 A | 12/2000 | Lundquist et al. |
| 6,194,636 B1 | 2/2001 | McElroy et al. |
| 6,232,526 B1 | 5/2001 | McElroy et al. |
| 6,252,138 B1 | 6/2001 | Karimi et al. |
| 6,277,608 B1 | 8/2001 | Hartley et al. |
| 6,288,312 B1 | 9/2001 | Christou et al. |
| 6,294,714 B1 | 9/2001 | Matsunaga et al. |
| 6,329,571 B1 | 12/2001 | Hiei |
| 6,365,807 B1 | 4/2002 | Christou et al. |
| 6,384,301 B1 | 5/2002 | Martinell et al. |
| 6,399,861 B1 | 6/2002 | Anderson et al. |
| 6,403,865 B1 | 6/2002 | Koziel et al. |
| 6,426,446 B1 | 7/2002 | McElroy et al. |

(Continued)

FOREIGN PATENT DOCUMENTS

WO  WO 2005/110068 A2  11/2005
WO  WO2006105436 A2  10/2006

(Continued)

OTHER PUBLICATIONS

Baulcombe (Nature 431, p. 356-363, 2004).*
Mallory et al (EMBO, 23, p. 3356-3364, 2004).*
Baulcombe et al (Nature, 431, p. 356-363, 2004).*
Hibio et al (Scientific Reports, 2(996), p. 1-10, 2012).*
EP09774436.6 Supplemental Search Report dated Jul. 25, 2011.
Zeng et al "MicroRNAs and small interfering RNAs can inhibit mRNA expression by similar mechanisms" PNAS (2003) 100(17):9779-9784.

(Continued)

*Primary Examiner* — David T Fox
*Assistant Examiner* — Stephen Uyeno
(74) *Attorney, Agent, or Firm* — Amanda Carmany-Rampey; Maria Magarita D. Unson; Arnold & Porter LLP

(57) ABSTRACT

This invention provides recombinant DNA constructs and methods for manipulating expression of a target gene that is regulated by a small RNA, by interfering with the binding of the small RNA to its target gene. More specifically, this invention discloses recombinant DNA constructs encoding cleavage blockers, 5-modified cleavage blockers, and translational inhibitors useful for modulating expression of a target gene and methods for their use. Further disclosed are miRNA targets useful for designing recombinant DNA constructs including miRNA-unresponsive transgenes, miRNA decoys, cleavage blockers, 5-modified cleavage blockers, and translational inhibitors, as well as methods for their use, and transgenic eukaryotic cells and organisms containing such constructs.

7 Claims, 4 Drawing Sheets

(56) References Cited

U.S. PATENT DOCUMENTS

| | | | |
|---|---|---|---|
| 6,433,252 | B1 | 8/2002 | Kriz et al. |
| 6,437,217 | B1 | 8/2002 | McElroy et al. |
| 7,026,528 | B2 | 4/2006 | Cheng et al. |
| 7,232,806 | B2 | 6/2007 | Tuschl et al. |
| 2001/0042257 | A1 | 11/2001 | Connor-Ward et al. |
| 2002/0007051 | A1 | 1/2002 | Cheo et al. |
| 2004/0106198 | A1 | 6/2004 | Hanley et al. |
| 2004/0115642 | A1 | 6/2004 | Fu |
| 2004/0123347 | A1 | 6/2004 | Hinchey et al. |
| 2004/0126845 | A1 | 7/2004 | Eenennaam et al. |
| 2004/0216189 | A1 | 10/2004 | Houmard et al. |
| 2004/0244075 | A1 | 12/2004 | Cai et al. |
| 2005/0144669 | A1 | 6/2005 | Reinhart et al. |
| 2006/0021087 | A1 | 1/2006 | Baum et al. |
| 2006/0200878 | A1 | 9/2006 | Lutfiyya et al. |
| 2007/0011775 | A1* | 1/2007 | Allen et al. .................. 800/279 |
| 2007/0199095 | A1 | 8/2007 | Allen et al. |
| 2007/0300329 | A1 | 12/2007 | Allen et al. |
| 2008/0050744 | A1 | 2/2008 | Brown et al. |
| 2008/0115240 | A1 | 5/2008 | Aukerman et al. |
| 2008/0256667 | A1 | 10/2008 | Dersch et al. |
| 2008/0280361 | A1 | 11/2008 | Calabotta et al. |
| 2009/0070898 | A1 | 3/2009 | Allen et al. |

FOREIGN PATENT DOCUMENTS

| | | |
|---|---|---|
| WO | WO2006105436 A3 | 10/2006 |
| WO | WO 2007/003023 A2 | 1/2007 |
| WO | WO 2008/027592 A2 | 3/2008 |
| WO | WO 2008/049183 A1 | 5/2008 |
| WO | WO2008133643 A2 | 11/2008 |
| WO | WO2008133643 A3 | 11/2008 |

OTHER PUBLICATIONS

Zeng et al "Sequence requirements for micro RNA processing and function in human cells" RNA Journal (2003) 9:112-123.
Parizotto et al "In vivo investigation of the transcription, processing, endonucleolytic activity, and functional relevance of the spatial distribution of a plant miRNA" Genes&Development (2004) 18:2237-2242.
Axtell et al "A Two-Hit Trigger for siRNA Biogenesis in Plants" Cell (2006) 127:565-577.
Zorrilla et al "Target mimicry provides a new mechanism for regulation of microRNA activity" Nature Genetics (2007) 39(8):1033-1037.
Jones-Rhoades et al "MicroRNAs and Their Regulatory Roles in Plants" Annu. Rev. Plant Biol. (2006) 57:19-53.
Rhoades et al "Prediction of Plant MicroRNA Targets" Cell (2002) 110:513-520.
Choi et al "Target Protectors Reveal Dampening and Balancing of Nodal Agonist and Antagonist by miR-430" Science (2007) 318:271-274.
CN2009801316969 First Office Action issued Apr. 12, 2012.
CN2009801316969 Second Office Action issued Nov. 29, 2012.
CN2009801316969 Third Office Action issued May 31, 2013.
EP097744346 First Exam Report issued Jul. 18, 2013.
PCTUS2009049392 Search Report and Written Opinion issued Oct. 21, 2009.
PCTUS2009049392 IPRP issued Jun. 22, 2010.
Baulcombe et al. RNA Silencing in Plants. Nature. (2004) 431:356-63.
Hibio et al. Stability of miRNA 5'terminal and seed regions. Scientific Reports. (2012) 2(996):1-10.
Mallory et al. MicroRNA control of PHABULOSA in leaf development. EMBO (2004) 23:3356-3364.
CN2009801316969 Fourth Office Action issued Dec. 18, 2013.
AU2009267007 First Exam Report issued Apr. 29, 2014.
Allen et al., "microRNA-Directed Phasing during *Trans*-Acting siRNA Biogenesis in Plants," *Cell*, 121:207-221 (2005).
Ambros et al., "A uniform system for microRNA annotation," *RNA*, 9:277-279 (2003).

Aslanidis et al., "Ligation-independent cloning of PCR products (LIC-POR)," *Nucleic Acids Research*, 18(20):6069-6074 (1990).
Axtell et al., "Common Functions for Diverse Small RNAs of Land Plants," *The Plant Cell*, 19:1750-1769 (2007).
Bayer et al., "Programmable ligand-controlled riboregulators of eukaryotic gene expression," *Nature Biotechnol.*, 23(3):337-343 (2005).
Borsani et al., "Endogenous siRNAs Derived from a Pair of Natural *cis*-Antisense Transcripts Regulate Salt Tolerance in *Arabidopsis*," *Cell*, 123:1279-1291 (2005).
Davidson et al., "Engineering regulatory RNAs," *TRENDS in Biotechnology*, 23(3):109-112 (2005).
De Amicis et al., "Intercodon dincleotides affect codon choice in plant genes," *Nucleic Acid Research*, 28(17):3339-3346 (2000).
De Framond, "MINI-Ti: A New Vector Strategy for Plant Genetic Engineering," *Nature Biotechnology*, 1:262-269 (1983).
Ellington et al., "In vitro selection of RNA molecules that bind specific ligands," *Nature*, 346:818-822 (1990).
Fattash et al., "Evidence for the rapid expansion of microRNA-mediated regulation in early land plant evolution," *BMC Plant Biol.*, 7:13 (2007).
Hamilton et al., "Two classes of short interfering RNA in RNA silencing," *The EMBO Journal*, 21(17):4671-4679 (2002).
Hoekema et al., "A binary plant vector strategy based on separation of *vir*- and T-region of the *Agrobacterium tumefaciens* Ti-plasmid," *Nature*, 303:179-180 (1983).
Isaacs et al., "Engineered riboregulators enable post-transcriptional control of gene expression," *Nature Biotechnology*, 22(7):841-847 (2004).
Kasschau et al., "P1/HC-Pro, a Viral Suppressor of RNA Silencing, Interferes with *Arabidopsis* Development and miRNA Function," *Dev. Cell*, 4:205-217 (2003).
Kim, "MicroRNA Biogenesis: Coordinated Cropping and Dicing," *Nature Reviews | Molecular Cell Biology*, 6:376-385 (2005).
Khvorova et al., "Functional siRNAs and miRNAs Exhibit Strand Bias," *Cell*, 115:209-216 (2003).
Kościańska et al., "Analysis of RNA silencing in agroinfiltrated leaves of *Nicotiana benthamiana* and *Nicotiana tabacum*," *Plant Mol. Biol.*, 59:647-661 (2005).
Lau et al., "Characterization of the piRNA Complex from Rat Testes," *Science*, 313:363-367 (2006).
Lauter et al., "microRNA 172 down-regulates glossy15 to promote vegetative phase change in maize," *Proc. Natl. Acad. Sci. USA*, 102(26):9412-9417 (2005).
Lee et al., "Aptamer Database," *Nucleic Acids Research*, 32:D95-D100 (2004).
Llave et al., "Cleavage of Scarecrow-*like* mRNA Targets Directed by a Class of *Arabidopsis* miRNA," *Science*, 297:2053-2056 (2002).
Lu et al., "RNA silencing in plants by the expression of siRNA duplexes," *Nucleic Acids Res.*, 32(21):e171 (2004).
Lu et al., "Novel and Mechanical Stress—Responsive MicroRNAs in *Populus trichocarpa* That Are Absent from *Arabidopsis*," *The Plant Cell*, 17:2186-2203 (2005).
Lu et al., "Genome-wide analysis for discovery of rice microRNAs reveals natural antisense microRNAs (nat-miRNAs)," *Proc. Natl. Acad. Sci. USA*, 105: 4951-4956 (2008).
Luo et al.,"Rice embryogenic calli express a unique set of microRNAs, suggesting regulatory roles of microRNAs in plant post-embryogenic development," *FEBS Lett.*, 580:5111-5116 (2006).
Makeyev et al., "Multilevel Regulation of Gene Expression by MicroRNAs," *Science*, 319:1789-1790 (2008).
Mandal et al., "Adenine riboswitches and gene activation by disruption of a transcription terminator," *Nature Struct. Mol. Biol.*, 11(1):29-35 (2004).
Mandal et al., "Gene Regulation by Riboswitches," *Nature Reviews | Molecular Cell Biology*, 5:451-463 (2004).
Mi et al., "Sorting of Small RNAs into *Arabidopsis* Argonaute Complexes Is Directed by the 50' Terminal Nucleotide," *Cell*, 133:116-127 (2008).
Molnár et al., "miRNAs control gene expression in the single-cell alga *Chlamydominas reinhardtii*," *Nature*, 447:1126-1130 (2007).
O'Donnell et al., "Mighty Piwis Defend the Germline against Genome Intruders," *Cell*, 129:37-44 (2007).

(56) References Cited

OTHER PUBLICATIONS

Rashtchian et al., "Uracil DNA Glycosylase-Mediated Cloning of Polymerase Chain Reaction-Amplified DNA: Application to Genomic and cDNA Cloning," *Analytical Biochemistry*, 206:91-97 (1992).
Rhoades et al., "Prediction of Plant MicroRNA Targets," *Cell*, 110:513-520 (2002).
Sanford, "Biolistic plant transformation," *Physiol. Plant.*, 79:206-209 (1990).
Schwarz et al., "Asymmetry in the Assembly of the RNAi Enzyme Complex," *Cell*, 115:199-208 (2003).
Sudarsan et al., "Metabolite-binding RNA domains are present in the genes of eukaryotes," *RNA*, 9:644-647 (2003).
Sunkar et al., "Cloning and Characterization of MicroRNAs from Rice," *The Plant Cell*, 17:1397-1411 (2005).
Tang et al., "Structural diversity of self-cleaving ribozymes," *Proc. Natl. Acad. Sci. USA*, 97(11):5784-5789 (2000).
Tuschl, "Expanding small RNA interference," *Nature Biotechnol.*, 20: 446-448 (2002).
Wetering et al., "Specific inhibition of gene expression using a stably integrated, inducible small-interfering-RNA vector" *EMBO Rep.*, 4(6): 609-615 (2003).
Winkler et al., "Thiamine derivatives bind messenger RNAs directly to regulate bacterial gene expression," *Nature*, 419:952-956 (2002).
Vazquez et al., "Endogenous *trans*-Acting siRNAs Regulate the Accumulation of *Arabidopsis* mRNAs," *Mol. Cell*, 16:69-79 (2004).
Zhang, "miRU: an automated plant miRNA target prediction server," *Nucleic Acids Research*, 33:W701-W704 (2005).

* cited by examiner

A

B

C

D

```
5'-CTCCACCGTCATTGTTCATCA-3'   (SEQ ID NO: 2)   (GL1 miRNA recognition site)
3'-GAGGTGGCAGTAACAAGTAGT-5'   (SEQ ID NO: 6)   (mature miRGL1)
3'-GAGGTGGCAGATACAAGTAGT-5'   (SEQ ID NO: 8)   (mature miRGL1-CB)
5'-gaCCACCGTCATTGTTCATCA-3'   (SEQ ID NO: 10)  (artificial GL1 recognition
                                                site in miRGL1-sensor)
```

E

Maize transformation base vector

SEQ ID NO. 2065

Soybean and canola transformation base vector

SEQ ID NO. 2066

Cotton transformation base vector

SEQ ID NO. 2067

RECOMBINANT DNA CONSTRUCTS ENCODING RIBONUCLEASE CLEAVAGE BLOCKERS AND METHODS FOR MODULATING EXPRESSION OF A TARGET GENE

CROSS-REFERENCE TO RELATED APPLICATIONS AND INCORPORATION OF SEQUENCE LISTINGS

This application claims the benefit of priority of U.S. Provisional Patent Application 61/077,244, filed 1 Jul. 2008, which is incorporated by reference in its entirety herein. The sequence listing that is contained in the file named "38-21_55745_A.txt", which is 2574 kilobytes (measured in operating system MS-Windows), was created on 27 Jun. 2008, and was filed by electronic submission with U.S. Provisional Patent Application 61/077,244 on 1 Jul. 2008 is incorporated by reference in its entirety herein. The sequence listing that is contained in the file named "38-21_55745_B$_{13}$replacement.txt", which is 2611 kilobytes (measured in operating system MS-Windows), created on 1 Sept. 2009, and electronically filed on 10 Sept. 2009 is incorporated herein by reference.

FIELD OF THE INVENTION

Disclosed herein are recombinant DNA constructs with DNA that undergoes processing to an RNA providing RNase III cleavage resistance to a target gene transcript. Such RNAs serve as cleavage blockers and translational inhibitors useful for modulating expression of a target gene. Further disclosed are miRNA recognition site sequences and their use in designing recombinant DNA constructs including miRNA-unresponsive transgenes, miRNA decoys, cleavage blockers, and translational inhibitors. Also disclosed are non-natural transgenic plant cells, plants, and seeds containing in their genome a recombinant DNA construct of this invention. Further disclosed are methods of modulating expression of a target gene using recombinant DNA constructs of this invention.

BACKGROUND OF THE INVENTION

Several cellular pathways involved in RNA-mediated gene suppression have been described, each distinguished by a characteristic pathway and specific components. Generally, RNA-mediated gene suppression involves a double-stranded RNA (dsRNA) intermediate that is formed intramolecularly within a single RNA molecule or intermolecularly between two RNA molecules. This longer dsRNA intermediate is processed by a ribonuclease of the RNase III family (Dicer or Dicer-like ribonuclease) to one or more small double-stranded RNAs, one strand of which is incorporated by the ribonuclease into the RNA-induced silencing complex ("RISC"). Which strand is incorporated into RISC is believed to depend on certain thermodynamic properties of the double-stranded small RNA, such as those described by Schwarz et al. (2003) *Cell*, 115:199-208, and Khvorova et al. (2003) *Cell*, 115:209-216.

The siRNA pathway involves the non-phased cleavage of a longer double-stranded RNA intermediate to small interfering RNAs ("siRNAs"). The size of siRNAs is believed to range from about 19 to about 25 base pairs, but common classes of siRNAs include those containing 21 base pairs or 24 base pairs. See, for example, Hamilton et al. (2002) *EMBO J.*, 21:4671-4679.

The microRNA pathway involves microRNAs ("miRNAs"), non-protein coding RNAs generally of between about 19 to about 25 nucleotides (commonly about 20-24 nucleotides in plants) that guide cleavage in trans of target transcripts, negatively regulating the expression of genes involved in various regulation and development pathways; see Ambros et al. (2003)*RNA*, 9:277-279. Naturally occurring miRNAs are derived from a primary transcript ("pri-miRNA") that is naturally processed to a shorter transcript ("pre-miRNA") which itself is further processed to the mature miRNA. For a recent review of miRNA biogenesis in both plants and animals, see Kim (2005) *Nature Rev. Mol. Cell Biol.*, 6:376-385. Gene regulation of biological pathways by miRNAs can occur at multiple levels and in different ways, including regulation of single or multiple genes, regulation of transcriptional regulators, and regulation of alternative splicing; see Makeyev & Maniatis (2008) *Science*, 319:1789-1790. Various utilities of miRNAs, their precursors, their recognition sites, and their promoters are described in detail in co-assigned U.S. Patent Application Publication 2006/0200878 A1, specifically incorporated by reference herein, which include: (1) the expression of a native miRNA or miRNA precursor sequence to suppress a target gene; (2) the expression of an engineered (non-native) miRNA or miRNA precursor sequence to suppress a target gene; (3) expression of a transgene with a miRNA recognition site, wherein the transgene is suppressed when the corresponding mature miRNA is expressed, either endogenously or transgenically; and (4) expression of a transgene driven by a miRNA promoter.

In the trans-acting siRNA ("ta-siRNA") pathway, miRNAs serve to guide in-phase processing of siRNA primary transcripts in a process that requires an RNA-dependent RNA polymerase for production of a double-stranded RNA precursor; trans-acting siRNAs are defined by lack of secondary structure, a miRNA target site that initiates production of double-stranded RNA, requirements of DCL4 and an RNA-dependent RNA polymerase (RDR6), and production of multiple perfectly phased ~21-nt small RNAs with perfectly matched duplexes with 2-nucleotide 3' overhangs (see Allen et al. (2005) *Cell*, 121:207-221; Vazquez et al. (2004) *Mol. Cell*, 16:69-79).

The phased small RNA ("phased sRNA") pathway (see PCT patent application PCT/US2007/019283, published as WO 2008/027592) is based on an endogenous locus termed a "phased small RNA locus", which transcribes to an RNA transcript forming a single foldback structure that is cleaved in phase in vivo into multiple small double-stranded RNAs (termed "phased small RNAs") capable of suppressing a target gene. In contrast to siRNAs, a phased small RNA transcript is cleaved in phase. In contrast to miRNAs, a phased small RNA transcript is cleaved by DCL4 or a DCL4-like orthologous ribonuclease (not DCL1) to multiple abundant small RNAs capable of silencing a target gene. In contrast to the ta-siRNA pathway, the phased small RNA locus transcribes to an RNA transcript that forms hybridized RNA independently of an RNA-dependent RNA polymerase and without a miRNA target site that initiates production of double-stranded RNA.

Gene suppression mediated by small RNAs processed from natural antisense transcripts has been reported in at least two pathways. In the natural antisense transcript small interfering RNA ("nat-siRNA") pathway (Borsani et al. (2005) *Cell*, 123:1279-1291), siRNAs are generated by DCL1 cleavage of a double-stranded RNA formed between the antisense transcripts of a pair of genes (cis-antisense gene pairs). A similar natural anti-sense transcript microRNA ("natmiRNA") pathway (Lu et al. (2008) *Proc. Natl. Acad. Sci. USA*, 105: 4951-4956) has also been reported. In metazoan animals, small RNAs termed Piwi-interacting RNAs ("piR-NAs") have been reported to also have gene-silencing activity (Lau et al. (2006) *Science*, 313:363-367; O'Donnell & Boeke (2007) *Cell*, 129:37-44).

SUMMARY OF THE INVENTION

In one aspect, this invention provides a recombinant DNA construct including DNA that undergoes processing to an RNA including single-stranded RNA that binds to the transcript of at least one target gene to form a hybridized segment of at least partially double-stranded RNA that imparts to the transcript resistance to cleavage by an RNase III ribonuclease within or in the vicinity of the hybridized segment.

Another aspect of this invention provides a recombinant DNA construct encoding a "cleavage blocker" for inhibiting double-stranded RNA-mediated suppression of the at least one target gene, thereby increasing expression of the target gene (relative to expression in the absence of the cleavage blocker). One embodiment is a recombinant DNA construct including DNA that undergoes processing to an RNA including single-stranded RNA that binds to the transcript of at least one target gene to form a hybridized segment of at least partially double-stranded RNA that imparts to the transcript resistance to cleavage by an RNase III ribonuclease within or in the vicinity of the hybridized segment, wherein the binding of the single-stranded RNA to the transcript (and the resultant formation of the hybridized segment) inhibits double-stranded RNA-mediated suppression of the at least one target gene.

Another aspect of this invention provides a recombinant DNA construct encoding a a "5'-modified cleavage blocker". One embodiment includes a recombinant DNA construct including DNA that undergoes processing to an RNA including single-stranded RNA that binds to the transcript of at least one target gene to form a hybridized segment of at least partially double-stranded RNA that imparts to the transcript resistance to cleavage by an RNase III ribonuclease within or in the vicinity of the hybridized segment, wherein the binding of the single-stranded RNA to the transcript (and the resultant formation of the hybridized segment) inhibits double-stranded RNA-mediated suppression of the at least one target gene, wherein the cleavage by an RNase III ribonuclease is mediated by binding of a mature miRNA, the binding is at a miRNA recognition site (that is recognized by the mature miRNA) in the transcript, the cleavage of the transcript occurs at the miRNA recognition site, and the hybridized segment is formed at least partially within the miRNA recognition site, and the hybridized segment includes an A, G, or C (but not a U) at a position corresponding to the 5' terminus of the mature miRNA that natively binds to the recognition site, but does not require mismatches between the single-stranded RNA and the miRNA recognition site at positions of the miRNA recognition site corresponding to positions 9, 10, or 11 (in 3' to 5' direction) of the mature miRNA, or insertions at a position in the single-stranded RNA at positions of the miRNA recognition site corresponding to positions 10 or 11 (in 3' to 5' direction) of the mature miRNA.

Another aspect of this invention provides a recombinant DNA construct encoding a "translational inhibitor" for inhibiting translation of the transcript, thereby decreasing expression of the target gene (relative to expression in the absence of expression of the construct). One embodiment is a recombinant DNA construct including DNA that undergoes processing to an RNA including single-stranded RNA that binds to the transcript of at least one target gene to form a hybridized segment of at least partially double-stranded RNA that imparts to the transcript resistance to cleavage by an RNase III ribonuclease within or in the vicinity of the hybridized segment, wherein the binding of the single-stranded RNA to the transcript (and the formation of the hybridized segment) inhibits translation of the transcript.

Other aspects of this invention provide methods for modulating expression of miRNA target genes from plant species. Embodiments of this invention include methods to increase or improve yield of crop plants by expressing in such plants recombinant DNA constructs of this invention, for example, recombinant DNA constructs encoding a native miRNA precursor sequence or an artificial precursor sequence, or recombinant DNA constructs encoding a cleavage blocker or translational inhibitor or decoy.

Further aspects of this invention provide non-natural transgenic plant cells having in their genome a recombinant DNA construct of this invention. Also provided are a non-natural transgenic plant containing the transgenic plant cell of this invention, a non-natural transgenic plant grown from the transgenic plant cell of this invention, and non-natural transgenic seed produced by the transgenic plants, as well as commodity products produced from a non-natural transgenic plant cell, plant, or seed of this invention.

DETAILED DESCRIPTION OF THE INVENTION

Figure 1:
FIG. 1 depicts the predicted fold-back structures of the native miRNA miRMON1 precursor (FIG. 1A), the synthetic miRNA miRGL1 precursor (FIG. 1B), the synthetic cleavage blocker miRGL1-CB (FIG. 1C), and the synthetic 5'-modified miRGL1 cleavage blocker (FIG. 1D), as well as an alignment (FIG. 1E) of the miRNA recognition site in the target gene GL1, the mature miRGL1, the mature miRGL1-CB, and the artificial GL1 recognition site in the miRGL1-sensor, as described in Examples 1 and 2.
Figure 1:
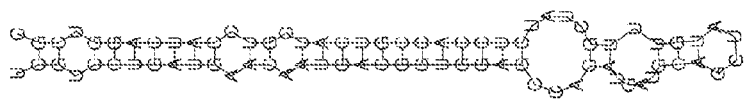
Figure 1:
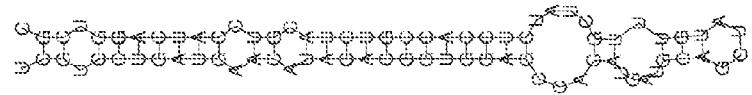
Figure 1:
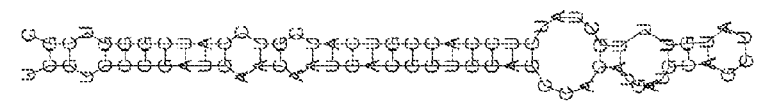

Unless otherwise stated, nucleic acid sequences in the text of this specification are given, when read from left to right, in the 5' to 3' direction. Nucleic acid sequences may be provided as DNA or as RNA, as specified; disclosure of one necessarily defines the other, as is known to one of ordinary skill in the art. The term "miRNA precursor", as used herein, refers to an RNA transcript that is naturally processed to produce a mature miRNA. Where a term is provided in the singular, the inventors also contemplate aspects of the invention described by the plural of that term.

Recombinant DNA Constructs that are Processed to RNA Providing RNase III Resistance to a Target Gene Transcript In one aspect, this invention provides a recombinant DNA construct including DNA that undergoes processing to an RNA including single-stranded RNA that binds to the transcript of at least one target gene to form a hybridized segment of at least partially double-stranded RNA that imparts to the transcript resistance to cleavage by an RNase III ribonuclease within or in the vicinity of the hybridized segment. The recombinant DNA construct is made by techniques known in the art, such as those described under the heading "Making and Using Recombinant DNA Constructs" and illustrated in the working Examples. The recombinant DNA construct is particularly useful for making transgenic plant cells, transgenic plants, and transgenic seeds as discussed below under "Making and Using Transgenic Plant Cells and Transgenic Plants". This invention therefore includes embodiments wherein the recombinant DNA construct is located within a vector for transforming a plant cell (such as within a plasmid or viral vector), or on a biolistic particle for transforming a plant cell, or within a chromosome or plastid of a non-natural transgenic plant cell, or within a non-natural transgenic cell, non-natural transgenic plant tissue, non-natural transgenic plant seed, non-natural transgenic pollen grain, or a non-natural transgenic or partially transgenic plant. Further included are embodiments wherein the recombinant DNA construct is in a commodity product produced from a non-natural transgenic cell, non-natural transgenic plant tissue, non-natural transgenic plant seed, non-natural transgenic pollen grain, or a non-natural transgenic or partially transgenic plant of this invention; such commodity products include, but are not limited to harvested leaves, roots, shoots, tubers, stems, fruits, seeds, or other parts of a plant, meals, oils, extracts, fermentation or digestion products, crushed or whole grains or seeds of a plant, or any food or non-food product including such commodity products produced from a transgenic plant cell, plant, or seed of this invention.

The processing of the DNA includes transcription of the DNA to a primary RNA transcript, which may undergo one or more additional natural processing steps that result in the single-stranded RNA that binds to the transcript of at least one target gene. In one embodiment, the processing of the DNA includes transcription of the DNA to an RNA intermediate including one or more double-stranded RNA stems; the double-stranded RNA stem or stems is further processed to single-stranded RNA. A final product of the DNA processing is the RNA including single-stranded RNA that binds to the transcript of at least one target gene.

For example, the recombinant DNA construct includes DNA that is transcribed to a primary transcript with a sequence derived from a native pri-miRNA or pre-miRNA sequence that forms secondary structure including one or more double-stranded stems, followed by processing of the primary transcript to a shorter, at least partially double-stranded intermediate (similar to a pre-miRNA) which is then cleaved by an RNase III ribonuclease (ribonuclease III, e.g., Drosha or DCL1 or a DCL1-like orthologous ribonuclease) to a pair of single-stranded RNAs (similar to a miRNA and a miRNA* pair). In another example, the recombinant DNA construct includes DNA that is transcribed to a primary transcript that forms secondary structure including one or more double-stranded stems, followed by cleavage of the double-stranded RNA stem(s) by an RNase III ribonuclease to one or more pairs of single-stranded small RNAs (similar to an siRNA duplex). In another example, the recombinant DNA construct includes DNA that is transcribed to a primary transcript that includes one or more spliceable introns that are removed by intronic processing. In yet another example, the recombinant DNA construct includes DNA that is transcribed to a primary transcript including one or more self-cleaving ribozymes (see, e.g., Tang & Breaker (2000) *Proc. Natl. Acad. Sci. USA*, 97:5784-5789); removal of the ribozyme(s) results in the RNA including single-stranded RNA that binds to the transcript of at least one target gene.

The RNA resulting from processing of the DNA includes at least single-stranded RNA that binds to the transcript of at least one target gene. In one embodiment, the RNA resulting from processing of the DNA consists of one single-stranded RNA molecule that binds to the transcript of one target gene. In another embodiment, the RNA resulting from processing of the DNA consists of one single-stranded RNA molecule that binds to the transcripts of multiple target genes. In another embodiment, the RNA resulting from processing of the DNA consists of multiple molecules of single-stranded RNA that bind to the transcript of at least one target gene; this can result, e.g., from processing of a primary RNA transcript having multiple segments, each including single-stranded RNA that binds to the transcript of at least one target gene, for example, where the multiple segments (which can have the same or different sequence) are separated by self-cleaving ribozymes and cleavage of the ribozymes yields the multiple single-stranded RNAs. In another embodiment, the RNA resulting from processing of the DNA includes single-stranded RNA that binds to the transcript of at least one target gene, as well as additional RNA elements (which may be single-stranded or double-stranded or both), such as, but not limited to, an RNA aptamer, an RNA riboswitch, a ribozyme, site-specific recombinase recognition sites, or an RNA sequence that serves to regulate transcription of the single-stranded RNA that binds to the transcript of at least one target gene.

In various embodiments, the at least one target gene includes: coding sequence, non-coding sequence, or both coding and non-coding sequences; a single target gene or multiple target genes (for example, multiple alleles of a target gene, or multiple different target genes); or one or more of (a) an endogenous gene of a eukaryote, (b) a transgene of a transgenic plant, (c) an endogenous gene of a pest or pathogen of a plant, and (d) an endogenous gene of a prokaryotic or eukaryotic symbiont associated with a pest or pathogen of a plant. Target genes that can be regulated by a recombinant DNA construct of this invention are described in detail below under the heading "Target Genes".

The single-stranded RNA binds to the transcript of at least one target gene to form a hybridized segment of at least partially (in some cases perfectly) double-stranded RNA. In some embodiments the percent complementarity between the single-stranded RNA and the transcript of at least one target gene is 100%. However, it is clear that Watson-Crick base-pairing need not be complete between the single-stranded RNA and the transcript of at least one target gene, but is at least sufficient so that under physiological conditions a stably hybridized segment of at least partially double-stranded RNA is formed between the two.

The hybridized segment of double-stranded RNA imparts to the transcript resistance to cleavage by an RNase III ribonuclease (for example, Drosha or Dicer or Dicer-like proteins, including, but not limited to, DCL1, DCL2, DCL3, DCL4, DCL1-like, DCL2-like, DCL3-like, or DCL4-like proteins) within or in the vicinity of the hybridized segment. In many instances, the resistance imparted is resistance to cleavage by an RNase III ribonuclease within the hybridized segment. For example, where the single-stranded RNA binds to the transcript of at least one target gene at a miRNA recognition site in the transcript recognized and bound by an endogenous miRNA, such that the hybridized segment encompasses the miRNA recognition site, the hybridized segment of double-stranded RNA imparts to the transcript resistance to cleavage by an RNase III ribonuclease at the miRNA recognition site (i.e., within the hybridized segment). In other instances, the resistance imparted is resistance to cleavage by an RNase III ribonuclease in the vicinity of the hybridized segment. For example, where the single-stranded RNA binds to the transcript of at least one target gene immediately or closely adjacent to a miRNA recognition site in the transcript recognized and bound by an endogenous miRNA, such that the hybridized segment does not encompass the miRNA recognition site but is sufficiently close to prevent binding by the endogenous miRNA to the transcript, the hybridized segment of double-stranded RNA imparts to the transcript resistance to cleavage by an RNase III ribonuclease at the miRNA recognition site (i.e., in the vicinity of, but not within, the hybridized segment).

The length of the single-stranded RNA is not necessarily equal to the length of the hybridized segment, since not all of the single-stranded RNA necessarily binds to the transcript of at least one target gene. In some embodiments, the length of the single-stranded RNA is about equal to, or exactly equal to, the length of the hybridized segment. In other embodiments, the length of the single-stranded RNA is greater than the length of the hybridized segment. Expressed in terms of numbers of contiguous nucleotides, the length of the single-stranded RNA is generally from between about 10 nucleotides to about 500 nucleotides, or from between about 20 nucleotides to about 500 nucleotides, or from between about 20 nucleotides to about 100 nucleotides, for example, about 10, 11, 12, 13, 14, 15, 16, 17, 18, 19, 20, 21, 22, 23, 24, 25, 26, 27, 28, 29, about 30, about 35, about 40, about 45, about 50, about 60, about 70, about 80, about 90, about 100, about 120, about 140, about 160, about 180, about 200, about 240, about 280, about 320, about 360, about 400, or about 500 nucleotides. Expressed in terms of numbers of contiguous nucleotides (and recognizing that the hybridized segment can include nucleotides that are not base-paired), the length of the hybridized segment is generally from between about 10 nucleotides to about 100 nucleotides, or from between about 10 nucleotides to about 24 nucleotides, or from between about 20 nucleotides to about 100 nucleotides, or from between about 26 nucleotides to about 100 nucleotides, although it can be greater than about 100 nucleotides, and in some preferred embodiments it is preferably smaller than 100 nucleotides (such as in some embodiments of translational inhibitors, described below under the heading "Translational Inhibitors"). In preferred embodiments, the length of the hybridized segment is about 10, 11, 12, 13, 14, 15, 16, 17, 18, 19, 20, 21, 22, 23, 24, 25, 26, 27, 28, 29, about 30, about 35, about 40, about 45, about 50, about 60, about 70, about 80, about 90, or about 100 nucleotides. In one particularly preferred embodiment, the length of the hybridized segment is between about 10 to about 24 nucleotides, e.g., about 10, 11, 12, 13, 14, 15, 16, 17, 18, 19, 20, 21, 22, 23, or 24 nucleotides.

In many embodiments, the recombinant DNA construct of this invention includes other DNA elements in addition to the DNA that undergoes processing to an RNA including single-stranded RNA that binds to the transcript of at least one target gene to form a hybridized segment of at least partially double-stranded RNA that imparts to the transcript resistance to cleavage by an RNase III ribonuclease within or in the vicinity of the hybridized segment. These additional DNA elements include at least one element selected from the group consisting of:

(a) a promoter functional in a eukaryotic (plant, animal, fungus, or protist) cell, such as any of the promoters described under the heading "Promoters";

(b) a Pol III promoter (see "Promoters", below) operably linked to the DNA that undergoes processing to an RNA including single-stranded RNA;

(c) DNA that is processed to an RNA aptamer (as described under the heading "Aptamers")

(d) a transgene transcription unit (as described under the heading "Transgene Transcription Units");

(e) DNA encoding a spliceable intron (as described under the heading "Introns");

(f) DNA encoding a self-splicing ribozyme (as described under the heading "Ribozymes");

(g) DNA encoding a site-specific recombinase recognition site (as described under the heading "Recombinases");

(h) DNA encoding a gene suppression element (as described under the heading "Gene Suppression Elements"); and (i) DNA encoding a transcription regulatory element (as described under the heading "Transcription Regulatory Elements").

The recombinant DNA construct of this invention is particularly useful for providing an RNA that functions as a "cleavage blocker" or a "translational inhibitor", according to the RNA's interaction with the transcript of the target gene(s). Cleavage blockers and translational inhibitors are described in more detail below.

Cleavage Blockers

One aspect of this invention is a recombinant DNA construct including DNA that undergoes processing to an RNA including single-stranded RNA that binds to the transcript of at least one target gene to form a hybridized segment of at least partially double-stranded RNA that imparts to the transcript resistance to cleavage by an RNase III ribonuclease within or in the vicinity of the hybridized segment, wherein the binding of the single-stranded RNA to the transcript (and the resultant formation of the hybridized segment) inhibits double-stranded RNA-mediated suppression of the at least one target gene. In this context, the term "cleavage blocker" generally refers to the RNA including single-stranded RNA that binds to the transcript of at least one target gene, and more specifically refers to the portion(s) of the single-stranded RNA that forms a hybridized segment of at least partially double-stranded RNA with the transcript. Cleavage blockers inhibit double-stranded RNA-mediated suppression of the at least one target gene, thereby increasing expression of the target gene (relative to expression in the absence of the cleavage blocker).

Generally, the cleavage by an RNase III ribonuclease is mediated by binding of a small RNA (most preferably a small RNA that is associated with a silencing complex) to the transcript. In preferred embodiments, the small RNA is selected from the group consisting of a miRNA, an siRNA, a trans-acting siRNA, a phased small RNA, a natural antisense transcript siRNA, and a natural antisense transcript miRNA; however, the small RNA can be any small RNA associated with a silencing complex such as RISC or an Argonaute or Argonaute-like protein. In some embodiments, the small RNA is an endogenous small RNA (e.g., an endogenous miRNA); in other embodiments, the small RNA is a transgenic small RNA (e.g., a transgenically expressed engineered miRNA).

In various embodiments, the length of the hybridized segment includes between about 10 base pairs to about 100 base pairs, although it can be greater than about 100 base pairs. In preferred embodiments (and recognizing that the hybridized segment can include nucleotides that are not base-paired), the length of the hybridized segment includes between about 10 base pairs to about 100 base pairs, such as from between about 10 to about 20, or between about 10 to about 24, or between about 10 to about 30, or between about 10 to about 40, or between about 10 to about 50, or between about 18 to about 28, or between about 18 to about 25, or between about 18 to about 24, or between about 20 to about 30, or between about 20 to about 40, or between about 20 to about 50 base pairs. In preferred embodiments, the length of the hybridized segment is about 10, 11, 12, 13, 14, 15, 16, 17, 18, 19, 20, 21, 22, 23, 24, 25, 26, 27, 28, 29, about 30, about 34, about 40, about 45, about 50, about 60, about 70, about 80, about 90, or about 100 base pairs, wherein the hybridized segment optionally includes additional nucleotides that are not base-paired and that are not counted in the length of the hybridized segment when this is expressed in terms of base pairs. In particularly preferred embodiments, the length of the hybridized segment is between about 18 to about 28 base pairs (that is, 18, 19, 20, 21, 22, 23, 24, 25, 26, 27, or 28 base pairs), or between about 10 to about 24 base pairs (that is, 10, 11, 12, 13, 14, 15, 16, 17, 18, 19, 20, 21, 22, 23, or 24 base pairs), or between about 18 to about 24 base pairs (that is, 18, 19, 20, 21, 22, 23, or 24 base pairs) wherein the hybridized segment optionally includes additional nucleotides that are not base-paired and that are not counted in the length of the hybridized segment when this is expressed in terms of base pairs. One of skill in the art is able to determine what number of unpaired nucleotides is acceptable for a given hybridized segment, i.e., that will still allow formation hybridized segment that is stable under physiological conditions and is resistant to RNase III ribonuclease cleavage.

In some instances, the hybridized segment is completely base-paired, that is, contains a contiguous ribonucleotide sequence that is the same length as, and is perfectly complementary to, a contiguous ribonucleotide sequence of the target gene transcript. In particularly preferred embodiments, however, the hybridized segment is not completely base-paired, and includes at least one mismatch or at least one insertion in the hybridized segment at a position that results in inhibiting cleavage of the transcript by the RNase III ribonuclease.

One aspect of this invention provides a "miRNA cleavage blocker". One preferred embodiment is a recombinant DNA construct including DNA that undergoes processing to an RNA including single-stranded RNA that binds to the transcript of at least one target gene to form a hybridized segment of at least partially double-stranded RNA that imparts to the transcript resistance to cleavage by an RNase III ribonuclease within or in the vicinity of the hybridized segment, wherein the binding of the single-stranded RNA to the transcript (and the resultant formation of the hybridized segment) inhibits double-stranded RNA-mediated suppression of the at least one target gene, wherein the cleavage by an RNase III ribonuclease is mediated by binding of a mature miRNA, the binding is at a miRNA recognition site (that is recognized by the mature miRNA) in the transcript, the cleavage of the transcript occurs at the miRNA recognition site, and the hybridized segment is formed at least partially within the miRNA recognition site. In this embodiment, the recombinant DNA construct yields a miRNA cleavage blocker RNA that binds to (or in the vicinity of) a miRNA recognition site in a target gene transcript, forming a hybridized segment that is itself resistant to RNase III ribonuclease cleavage (or that prevents RNase III ribonuclease cleavage of the transcript in the vicinity of the hybridized segment), thus preventing the mature miRNA that normally recognizes the miRNA recognition site from binding to the miRNA recognition site and mediating RNase III ribonuclease cleavage of the target gene transcript. In particularly preferred embodiments, the hybridized segment includes: (a) at least one mismatch between the single-stranded RNA and the miRNA recognition site at positions of the miRNA recognition site corresponding to positions 9, 10, or 11 (in 3' to 5' direction) of the mature miRNA, or (b) at least one insertion at a position in the single-stranded RNA at positions of the miRNA recognition site corresponding to positions 10 or 11 (in 3' to 5' direction) of the mature miRNA. In some preferred embodiments, the single-stranded RNA that binds to the transcript of at least one target gene has a nucleotide sequence to allow a stably hybridized segment to be formed between it and the target gene transcript, but that inhibits binding of an Argonaute or Argonaute-like protein to the hybridized segment, as described by Mi et al. (2008) Cell, 133:1-12; for example, the single-stranded RNA has a nucleotide sequence that includes an A, G, or C (but not a U) at a position corresponding to the 5' terminus of the mature miRNA that natively binds to the recognition site. Most preferably, the binding of a miRNA cleavage blocker to the target gene transcript results in inhibition of miRNA-mediated suppression of the at least one target gene, thereby increasing expression of the target gene (relative to expression in the absence of the miRNA cleavage blocker).

Another aspect of this invention includes a "5'-modified cleavage blocker". A preferred embodiment includes a recombinant DNA construct including DNA that undergoes processing to an RNA including single-stranded RNA that binds to the transcript of at least one target gene to form a hybridized segment of at least partially double-stranded RNA that imparts to the transcript resistance to cleavage by an RNase III ribonuclease within or in the vicinity of the hybridized segment, wherein the binding of the single-stranded RNA to the transcript (and the resultant formation of the hybridized segment) inhibits double-stranded RNA-mediated suppression of the at least one target gene, wherein the cleavage by an RNase III ribonuclease is mediated by binding of a mature miRNA, the binding is at a miRNA recognition site (that is recognized by the mature miRNA) in the transcript, the cleavage of the transcript occurs at the miRNA recognition site, and the hybridized segment is formed at least partially within the miRNA recognition site, and the hybridized segment includes an A, G, or C (but not a U) at a position corresponding to the 5' terminus of the mature miRNA that natively binds to the recognition site, but does not include mismatches between the single-stranded RNA and the miRNA recognition site at positions of the miRNA recognition site corresponding to positions 9, 10, or 11 (in 3' to 5' direction) of the mature miRNA, or insertions at a position in the single-stranded RNA at positions of the miRNA recognition site corresponding to positions 10 or 11 (in 3' to 5' direction) of the mature miRNA. Binding of such a 5'-modified cleavage blocker to the target gene transcript results in inhibition of miRNA-mediated suppression of the at least one target gene, thereby increasing expression of the target gene (relative to expression in the absence of the cleavage blocker).

One of ordinary skill in the art easily recognizes that various aspects of this invention include analogous recombinant DNA constructs that are processed to provide RNA including single-stranded RNA that serve as an "siRNA cleavage blocker", a "trans-acting siRNA cleavage blocker", a "phased small RNA cleavage blocker", a "natural antisense transcript siRNA cleavage blocker", or a "natural antisense transcript miRNA cleavage blocker" (or, in general terms, a "small RNA cleavage blocker"), according to whether the RNase III ribonuclease cleavage that is inhibited is mediated by, respectively, an siRNA, a trans-acting siRNA, a phased small RNA, a natural antisense transcript siRNA, or a natural antisense transcript miRNA (or, in general terms, any small RNA associated with a silencing complex such as RISC or an Argonaute or Argonaute-like protein). In these cases, the formation of the RNase III ribonuclease cleavage-resistant hybridized segment generally prevents the respective small RNA from binding to the target gene transcript and mediating RNase III ribonuclease cleavage of the transcript. Most preferably, the binding of such a small RNA cleavage blocker to the target gene transcript results in inhibition of double-stranded RNA-mediated suppression of the at least one target gene, thereby increasing expression of the target gene (relative to expression in the absence of the small RNA cleavage blocker). One of ordinary skill in the art is able to devise a nucleotide sequence for such an RNA including single-stranded RNA that, upon binding to the transcript of at least one target gene, forms a hybridized segment that is stable under physiological conditions and is resistant to RNase III ribonuclease cleavage, for example, (1) by selecting a nucleotide sequence that inhibits binding of an Argonaute or Argonaute-like protein to the hybridized segment, as described by Mi et al. (2008) *Cell, doi:*10.1016/j.cell.2008.02.034; (2) by selecting a nucleotide sequence such that the difference in free energy ("$\Delta\Delta G$", see Khvorova et al. (2003) *Cell,* 115, 209-216) between the portions of the single-stranded RNA and the target gene transcript that form the hybridized segment inhibit association with a silencing complex such as RISC or an Argonaute or Argonaute-like protein; or (3) by selecting a nucleotide sequence such that mismatches or insertions at a potential small RNA-mediated RNase III ribonuclease cleavage site prevents cleavage of the transcript. Knowledge of the target gene itself is not required, merely the sequence of the mature miRNA sequence or of a miRNA precursor that is processed to the mature miRNA—or, alternatively, knowledge of the miRNA recognition site sequence—in combination with the teachings of this application, in order to identify or design a cleavage blocker (or 5'-modified cleavage blocker) for inhibiting the target gene silencing effects of a given miRNA.

One approach to manipulating a miRNA-regulated pathway has been disclosed (see co-assigned U.S. patent application Ser. No. 11/974,469, published as U.S. Patent Application Publication 2009-0070898 A1, which disclosure including rules for predicting or designing a miRNA decoy sequence is specifically incorporated by reference herein) as a novel miRNA "decoy", a sequence that can be recognized and bound by an endogenous mature miRNA resulting in base-pairing between the miRNA decoy sequence and the endogenous mature miRNA, thereby forming a stable RNA duplex that is not cleaved because of the presence of mismatches between the miRNA decoy sequence and the mature miRNA.

The Examples of this application specifically identify miRNA targets recognized by particular miRNAs. Provided with this information and Applicants' teachings, one of ordinary skill in the art would be able to design and use various additional embodiments of this invention, including a recombinant DNA construct transcribable in a plant cell, including a promoter that is functional in the plant cell and operably linked to at least one polynucleotide selected from: (a) DNA encoding a cleavage blocker to prevent or decrease small RNA-mediated cleavage of the transcript of at least one miRNA target; (b) DNA encoding a 5'-modified cleavage blocker to prevent or decrease small RNA-mediated cleavage of the transcript of at least one miRNA target; (c) DNA encoding a translational inhibitor to prevent or decrease small RNA-mediated cleavage of the transcript of at least one miRNA target; (d) DNA encoding a decoy to prevent or decrease small RNA-mediated cleavage of the transcript of at least one miRNA target; (e) DNA encoding a miRNA-unresponsive transgene having a nucleotide sequence derived from the native nucleotide sequence of at least one miRNA target, wherein a miRNA recognition site in the native nucleotide sequence is deleted or otherwise modified to prevent miRNA-mediated cleavage; (f) DNA encoding a miRNA precursor which is processed into a miRNA for suppressing expression of at least one miRNA target; (g) DNA encoding double-stranded RNA which is processed into siRNAs for suppressing expression of at least one miRNA target; and (h) DNA encoding a ta-siRNA which is processed into siRNAs for suppressing expression of at least one miRNA target.

Translational Inhibitors

Another aspect of this invention is a recombinant DNA construct including DNA that undergoes processing to an RNA including single-stranded RNA that binds to the transcript of at least one target gene to form a hybridized segment of at least partially double-stranded RNA that imparts to the transcript resistance to cleavage by an RNase III ribonuclease within or in the vicinity of the hybridized segment, wherein the binding of the single-stranded RNA to the transcript (and the formation of the hybridized segment) inhibits translation of the transcript. In this context, the term "translational inhibitor" generally refers to the RNA including single-stranded RNA that binds to the transcript of at least one target gene, and more specifically refers to the portion(s) of the single-stranded RNA that forms a hybridized segment of at least partially double-stranded RNA with the transcript. Translational inhibitors inhibit translation of the transcript, thereby decreasing expression of the target gene (relative to expression in the absence of expression of the construct).

Binding of the translational inhibitor is to a location of the mRNA that is wholly or at least partially within the coding sequence or in a location such that the formation of the hybridized segment interferes with translation. In one embodiment, the binding of the single-stranded RNA to the transcript (and the formation of the hybridized segment) occurs at least partially within the 5' untranslated region of the transcript; this embodiment is often preferred where the transcript is of a plant target gene. In another embodiment, the binding of the single-stranded RNA to the transcript (and the formation of the hybridized segment) occurs at least partially within the 3' untranslated region of the transcript; this embodiment is preferred where the transcript is of an animal target gene. In yet another embodiment, the binding of the single-stranded RNA to the transcript occurs within or in the vicinity of the start codon or of the 5' cap, preferably preventing translation initiation.

In preferred embodiments, the hybridized segment is resistant to cleavage by the RNase III ribonuclease. In preferred embodiments, the length of the hybridized segment includes between about 10 base pairs to about 50 base pairs, although it can be greater than about 50 base pairs. In preferred embodiments (and recognizing that the hybridized segment can include nucleotides that are not base-paired), the length of the hybridized segment includes between about 10 base pairs to about 50 base pairs, such as from between about 10 to about 20, or between about 10 to about 30, or between about 10 to about 40, or between about 10 to about 50, or between about 18 to about 28, or between about 18 to about 25, or between about 18 to about 23, or between about 20 to about 30, or between about 20 to about 40, or between about 20 to about 50 base pairs. In preferred embodiments, the length of the hybridized segment is about 10, 11, 12, 13, 14, 15, 16, 17, 18, 19, 20, 21, 22, 23, 24, 25, 26, 27, 28, 29, about 30, about 34, about 40, about 45, or about 50 base pairs, wherein the hybridized segment optionally includes additional nucleotides that are not base-paired and that are not counted in the length of the hybridized segment when this is expressed in terms of base pairs. In particularly preferred embodiments, the length of the hybridized segment is between about 18 to about 28 base pairs, that is, 18, 19, 20, 21, 22, 23, 24, 25, 26, 27, or 28 base pairs, wherein the hybridized segment optionally includes additional nucleotides that are not base-paired and that are not counted in the length of the hybridized segment when this is expressed in terms of base pairs. One of skill in the art is able to determine what number of unpaired nucleotides is acceptable for a given hybridized segment, i.e., that will still allow formation hybridized segment that is stable under physiological conditions and is resistant to RNase III ribonuclease cleavage.

One of ordinary skill in the art is able to devise a nucleotide sequence for such an RNA including single-stranded RNA that, upon binding to the transcript of at least one target gene, forms a hybridized segment that is stable under physiological conditions and is resistant to RNase III ribonuclease cleavage, for example, (1) by selecting a nucleotide sequence that inhibits binding of an Argonaute or Argonaute-like protein to the hybridized segment, as described by Mi et al. (2008) Cell, doi:10.1016/j.cell.2008.02.034; (2) by selecting a nucleotide sequence such that the difference in free energy ("$\Delta\Delta G$", see Khvorova et al. (2003) Cell, 115, 209-216) between the portions of the single-stranded RNA and the target gene transcript that form the hybridized segment inhibit association with a silencing complex such as RISC or an Argonaute or Argonaute-like protein; or (3) by selecting a nucleotide sequence such that mismatches or insertions at a potential small RNA-mediated RNase III ribonuclease cleavage site prevents cleavage of the transcript. In a particularly preferred embodiment, the length of the hybridized segment includes between about 19 to about 50 base pairs, the hybridized segment includes smaller segments of 9 or fewer contiguous, perfectly complementary base pairs, and at least one mismatch or insertion is between each pair of the smaller segments.

Methods of Modulating Expression of a Target Gene

In another aspect, this invention provides a method of modulating expression of a target gene, including expressing in a cell a recombinant DNA construct of this invention, that is, a recombinant DNA construct including DNA that undergoes processing to an RNA including single-stranded RNA that binds to the transcript of at least one target gene to form a hybridized segment of at least partially double-stranded RNA that imparts to the transcript resistance to cleavage by an RNase III ribonuclease within or in the vicinity of the hybridized segment. Expressing in vivo in a cell a recombinant DNA construct of this invention provides an RNA that functions as a "cleavage blocker" or a "translational inhibitor".

By "modulating expression of a target gene" is meant either: (a) increasing expression of the target gene, e.g., where the recombinant DNA construct expressed in the cell provides a cleavage blocker, or (b) decreasing expression of the target gene, e.g., where the recombinant DNA construct expressed in the cell provides a translational inhibitor. By "expressing in a cell" is meant carrying out in vivo the process of transcription, as well as any additional natural processing steps necessary to provide the RNA including single-stranded RNA that binds to the transcript of at least one target gene.

The cell in which the recombinant DNA construct is expressed is in many embodiments a eukaryotic cell (such as a plant, animal, fungus, or protist cell), and in other embodiments is a prokaryotic cell (such as a bacterial cell). The target gene that has its expression modulated by the method of this invention is not necessarily an endogenous gene of the cell in which the recombinant DNA construct is expressed. For example, this invention encompasses a method including expressing in cells of a plant a recombinant DNA construct including DNA that undergoes processing to an RNA including single-stranded RNA that binds to the transcript of at least one target gene of a pest or pathogen of the plant to form a hybridized segment of at least partially double-stranded RNA that imparts to the transcript resistance to cleavage by an RNase III ribonuclease within or in the vicinity of the hybridized segment, thereby either (a) increasing expression of the target gene of the pest or pathogen, when the recombinant DNA construct provides a cleavage blocker, or (b) decreasing expression of the target gene of the pest or pathogen, when the recombinant DNA construct provides a translational inhibitor. Where the target gene is not an endogenous gene of the cell wherein the recombinant DNA construct is transcribed (such as in cells of a plant), additional processing steps may occur either in the cell where transcription occurred, or in other cells (such as in cells of a pest or pathogen of the plant).

In one embodiment of the method, the recombinant DNA construct is expressed in a cell to provide a cleavage blocker RNA. In this embodiment, the binding of the single-stranded RNA to the transcript (and the formation of the hybridized segment) inhibits double-stranded RNA-mediated suppression of the at least one target gene, thereby increasing expression of the target gene, relative to expression in the absence of expression of the construct.

In one embodiment of the method, the recombinant DNA construct is expressed in a cell to provide a translational blocker RNA. In this embodiment, the binding of the single-stranded RNA to the transcript (and the formation of the hybridized segment) inhibits translation of the transcript, thereby decreasing expression of the target gene, relative to expression in the absence of expression of the construct.

MicroRNAs (miRNAs) are believed to generally regulate gene expression post-transcriptionally in plants by directing sequence-specific cleavage of messenger RNAs ("mRNAs"). One aspect of this invention is a method to control the rate of post-transcriptional suppression of a plant gene that transcribes to a mRNA containing a miRNA recognition site that is normally recognized and bound by a specific miRNA in complex with Argonaute (Ago), followed by cleavage of the resulting miRNA/mRNA hybridized segment by an RNase III ribonuclease such as a Dicer-like ribonuclease. This method uses a "cleavage blocker" construct to transgenically express in planta an RNA including single-stranded RNA that binds to the mRNA transcript of the target gene to form a hybridized segment of at least partially double-stranded RNA that imparts to the transcript resistance to cleavage by an RNase III ribonuclease within or in the vicinity of the hybridized segment, wherein the binding of the single-stranded RNA to the transcript (and the resultant formation of the hybridized segment) inhibits double-stranded RNA-mediated suppression of the at least one target gene. The "cleavage blocker" RNA generally competes with endogenous mature miRNAs, for binding with an mRNA that is normally regulated by that miRNA; the cleavage blocker protects the mRNA from cleavage by the miRNA-Ago complex by binding to the miRNA target site on the mRNA to form a non-cleavable hybridized segment. Thus, a cleavage blocker protects the target mRNA's cleavage site (miRNA recognition site) from being cleaved by miRNA and prevents down-regulation of that particular target gene. Preferably, a cleavage blocker increases expression of the target gene (relative to its expression in the absence of the cleavage blocker). This method allows for regulation of gene expression in a specific manner and is a useful alternative to upregulating the level of a gene's transcript or its encoded protein by over-expression of the gene.

One aspect of this invention is a method for providing a cleavage blocker by generating the cleavage blocker single-stranded RNA in planta from a "cleavage blocker construct"

based on a recombinant miRNA-precursor-like sequence. A miRNA-precursor-like sequence is created by placing the cleavage blocker sequence in the backbone of a miRNA primary transcript, while maintaining the predicted secondary structure in the transcript's fold-back in such a way that resulting transcript is processed by Dicer-like ribonucleases to single-stranded RNA, which is then able to associate with the miRNA recognition site on the target mRNA and prevent the mRNA from being cleaved by a mature miRNA. The cleavage blocker sequence is selected such that, upon hybridization of the cleavage blocker to the target mRNA, a hybridized segment is formed that includes: (a) at least one mismatch between the single-stranded RNA and the miRNA recognition site at positions of the miRNA recognition site corresponding to positions 9, 10, or 11 of the mature miRNA, or (b) at least one insertion at a position in the single-stranded RNA at positions of the miRNA recognition site corresponding to positions 10-11 of the mature miRNA. In especially preferred embodiments, the single-stranded RNA that binds to the transcript of at least one target gene has a nucleotide sequence to allow a stably hybridized segment to be formed between it and the target gene transcript, but that inhibits binding of an Argonaute or Argonaute-like protein to the hybridized segment, as described by Mi et al. (2008) *Cell, doi:*10.1016/j.cell.2008.02.034; for example, the single-stranded RNA has a nucleotide sequence that includes an A, G, or C (but not a U) at a position corresponding to the 5' terminus of the mature miRNA that natively binds to the recognition site. For cleavage blockers expressed in transgenic plants, there is in many embodiments preferably also a mismatch between the single-stranded RNA and the miRNA recognition site at the position of the miRNA recognition site corresponding to positions 1 of the mature miRNA to prevent transitivity of the suppression effect.

An alternative method for generating a cleavage blocker in vivo or in planta is to express short single-stranded RNA from a strong promoter such as Pol II or Pol III promoters. This single-stranded RNA preferably includes sequence that is complimentary to the mRNA only at the miRNA recognition site. Because producing a cleavage blocker using this method does not require the association of the RNA with an Argonaute or Ago protein, mismatches at positions 10 and 11 are not required.

Target Genes

The recombinant DNA construct of this invention can be designed to modulate the expression of any target gene or genes. The target gene can be translatable (coding) sequence, or can be non-coding sequence (such as non-coding regulatory sequence), or both, and can include at least one gene selected from the group consisting of a eukaryotic target gene, a non-eukaryotic target gene, a microRNA precursor DNA sequence, and a microRNA promoter. The target gene can be native (endogenous) to the cell (e.g., a cell of a plant or animal) in which the recombinant DNA construct is transcribed, or can be native to a pest or pathogen (or a symbiont of the pest or pathogen) of the plant or animal in which the recombinant DNA construct is transcribed. The target gene can be an exogenous gene, such as a transgene in a plant. A target gene can be a native gene targetted for suppression, with or without concurrent expression of an exogenous transgene, for example, by including a gene expression element in the recombinant DNA construct, or in a separate recombinant DNA construct. For example, it can be desirable to replace a native gene with an exogenous transgene homologue.

The target gene can include a single gene or part of a single gene that is targetted for suppression, or can include, for example, multiple consecutive segments of a target gene, multiple non-consecutive segments of a target gene, multiple alleles of a target gene, or multiple target genes from one or more species. A target gene can include any sequence from any species (including, but not limited to, non-eukaryotes such as bacteria, and viruses; fungi; plants, including monocots and dicots, such as crop plants, ornamental plants, and non-domesticated or wild plants; invertebrates such as arthropods, annelids, nematodes, and molluscs; and vertebrates such as amphibians, fish, birds, domestic or wild mammals, and even humans.

In one embodiment, the target gene is exogenous to the plant in which the recombinant DNA construct is to be transcribed, but endogenous to a pest or pathogen (e.g., viruses, bacteria, fungi, oomycetes, and invertebrates such as insects, nematodes, and molluscs), or to a symbiont of the pest or pathogen, of the plant. The target gene can include multiple target genes, or multiple segments of one or more genes. In one embodiment, the target gene or genes is a gene or genes of an invertebrate pest or pathogen of the plant. Thus, a recombinant DNA construct of this invention can be transcribed in a plant and used to modulate the expression of a gene of a pathogen or pest that may infest the plant. These embodiments are particularly useful in providing non-natural transgenic plants having resistance to one or more plant pests or pathogens, for example, resistance to a nematode such as soybean cyst nematode or root knot nematode or to a pest insect.

Where the target gene is that of an invertebrate pest, the invertebrate pest is at least one or more invertebrate selected from the group consisting of insects, arachnids (e.g., mites), nematodes, molluscs (e.g., slugs and snails), and annelids, and can include an invertebrate associated with an invertebrate pest in a symbiotic relationship (e.g., the mutualistic relationship between some ant and aphid species). The term "symbiotic" relationship as used herein encompasses both facultative (non-obligate) and obligate symbioses wherein at least one of the two or more associated species benefits, and further includes mutualistic, commensal, and parasitic relationships. Symbionts also include non-invertebrate symbionts, such as prokaryotes and eukaryotic protists. An invertebrate pest can be controlled indirectly by targetting a symbiont that is associated, internally or externally, with the invertebrate pest. For example, prokaryotic symbionts are known to occur in the gut or other tissues of many invertebrates, including invertebrate pests of interest. examples of a targetted symbiont associated with an invertebrate pest include the aphid endosymbiotic bacteria *Buchnera; Wolbachia* bacteria that infect many insects; *Baumannia cicadellinicola* and *Sulcia muelleri*, the co-symbiotic bacteria of the glassy-winged sharpshooter (*Homalodisca coagulata*), which transmits the Pierce's disease pathogen *Xylella fastidiosa*; and eukaryotic protist (flagellate) endosymbionts in termites. In an alternative approach, expression of an endogenous target gene of the invertebrate pest can be modified in such a way as to control a symbiont of the invertebrate, in turn affecting the host invertebrate.

The target gene can be translatable (coding) sequence, or can be non-coding sequence (such as non-coding regulatory sequence), or both. examples of a target gene include non-translatable (non-coding) sequence, such as, but not limited to, 5' untranslated regions, promoters, enhancers, or other non-coding transcriptional regions, 3' untranslated regions, terminators, and introns. Target genes include genes encoding microRNAs, small interfering RNAs, and other small RNAs associated with a silencing complex (RISC) or an Argonaute protein; RNA components of ribosomes or ribozymes; small nucleolar RNAs; and other non-coding RNAs. Target genes can also include genes encoding transcription factors and genes encoding enzymes involved in the biosynthesis or catabolism of molecules of interest (such as, but not limited to, amino acids, fatty acids and other lipids, sugars and other carbohydrates, biological polymers, and secondary metabolites including alkaloids, terpenoids, polyketides, non-ribosomal peptides, and secondary metabolites of mixed biosynthetic origin).

In many embodiments, the target gene is an essential gene of a plant pest or pathogen (or of a symbiont of the pest or pathogen). Essential genes include genes that are required for development of the pest or pathogen to a fertile reproductive adult. Essential genes include genes that, when silenced or suppressed, result in the death of the organism (as an adult or at any developmental stage, including gametes) or in the organism's inability to successfully reproduce (e.g., sterility in a male or female parent or lethality to the zygote, embryo, or larva). A description of nematode essential genes is found, e.g., in Kemphues, K. "Essential Genes" (Dec. 24, 2005), WormBook, ed. The *C. elegans* Research Community, WormBook, doi/10.1895/wormbook.1.57.1, available on line at www(dot)wormbook(dot)org. A description of insect genes is publicly available at the *Drosophila* genome database (available on line at flybase(dot)bio(dot)indiana(dot) edu/), and 438 essential genes have been identified for *Drosophila* as a representative insect; see Boutros et al. (2004) *Science,* 303:832-835, and supporting material available on line at www.sciencemag(dot)org/cgi/content/full/303/5659/832/DC1. A description of bacterial and fungal essential genes is provided in the Database of Essential Genes ("DEG", available on line at tubic(dot)tju(dot)edu(dot)cn/deg/). Essential genes include those that influence other genes, where the overall effect is the death of the invertebrate pest or loss of the invertebrate pest's inability to successfully reproduce. In an example, suppression of the *Drosophila* homeobox gene *Caudal* leads eventually to host mortality caused by disequilibrium of the insect's commensal gut bacterial population (Ryu et al. (2008) *Science,* 319:777-782) and thus *Caudal* as well as the antimicrobial peptide genes directly controlled by *Caudal* are both considered essential genes.

Plant pest invertebrates include, but are not limited to, pest nematodes, pest molluscs (slugs and snails), pest annelids, and pest insects. Plant pathogens of interest include fungi, oomycetes, bacteria (e.g., the bacteria that cause leaf spotting, fireblight, crown gall, and bacterial wilt), mollicutes, and viruses (e.g., the viruses that cause mosaics, vein banding, flecking, spotting, or abnormal growth). See also G. N. Agrios, "Plant Pathology" (Fourth Edition), Academic Press, San Diego, 1997, 635 pp., for descriptions of fungi, bacteria, mollicutes (including mycoplasmas and spiroplasmas), viruses, nematodes, parasitic higher plants, and flagellate protozoans, all of which are plant pests or pathogens of interest. See also the updated compilation of plant pests and pathogens and the diseases caused by such on the American Phytopathological Society's "Common Names of Plant Diseases", available online at www(dot)apsnet(dot)org/online/common/top(dot)asp.

Examples of fungal plant pathogens of particular interest include, e.g., the fungi that cause powdery mildew, rust, leaf spot and blight, damping-off, root rot, crown rot, cotton boll rot, stem canker, twig canker, vascular wilt, smut, or mold, including, but not limited to, *Fusarium* spp., *Phakospora* spp., *Rhizoctonia* spp., *Aspergillus* spp., *Gibberella* spp., *Pyricularia* spp., and *Alternaria* spp., and the numerous fungal species provided in Tables 4 and 5 of U.S. Pat. No. 6,194,636, which is specifically incorporated in its entirety by reference herein. examples of plant pathogens include pathogens previously classified as fungi but more recently classified as oomycetes. Specific examples of oomycete plant pathogens of particular interest include members of the genus *Pythium* (e.g., *Pythium aphanidermatum*) and *Phytophthora* (e.g., *Phytophthora infestans, Phytophthora sojae,*) and organisms that cause downy mildew (e.g., *Peronospora farinosa*).

Examples of invertebrate pests include cyst nematodes *Heterodera* spp. especially soybean cyst nematode *Heterodera glycines*, root knot nematodes *Meloidogyne* spp., corn rootworms (*Diabrotica* spp.), *Lygus* spp., aphids and similar sap-sucking insects such as phylloxera (*Daktulosphaira vitifoliae*), corn borers, cutworms, armyworms, leafhoppers, Japanese beetles, grasshoppers, and other pest coleopterans, dipterans, and lepidopterans.

Specific examples of suitable target genes also include genes involved in amino acid or fatty acid synthesis, storage, or catabolism, genes involved in multi-step biosynthesis pathways, where it may be of interest to regulate the level of one or more intermediate; and genes encoding cell-cycle control proteins. Target genes can include genes encoding undesirable proteins (e.g., allergens or toxins) or the enzymes for the biosynthesis of undesirable compounds (e.g., undesirable flavor or odor components).

The recombinant DNA construct can be designed to be more specifically modulate the expression of the target gene, for example, by designing the recombinant DNA construct to include DNA that undergoes processing to an RNA including single-stranded RNA that binds to the target gene transcript, wherein the single-stranded RNA includes a nucleotide sequence substantially non-identical (or non-complementary) to a non-target gene sequence (and is thus less likely to bind to a non-target gene transcript). In one example, the recombinant DNA construct is designed to suppress a target gene that is a gene endogenous to a single species (e.g., Western corn rootworm, *Diabrotica virgifera virgifera* LeConte) but to not suppress a non-target gene such as genes from related, even closely related, species (e.g., Northern corn rootworm, *Diabrotica barberi* Smith and Lawrence, or Southern corn rootworm, *Diabrotica undecimpunctata*). In other embodiments, the recombinant DNA construct is designed to modulate the expression of a target gene sequence common to multiple species in which the target gene is to be silenced. For example, a recombinant DNA construct for modulating a target gene in corn rootworm can be selected to be specific to all members of the genus *Diabrotica*. In a further example of this embodiment, such a *Diabrotica*-targetted recombinant DNA construct can be selected so as to not target any gene sequence from beneficial insect species.

Promoters

Generally, the recombinant DNA construct of this invention includes a promoter, functional in the cell in which the construct is intended to be transcribed, and operably linked to the DNA that undergoes processing to an RNA including single-stranded RNA that binds to the transcript of at least one target gene. In various embodiments, the promoter is selected from the group consisting of a constitutive promoter, a spatially specific promoter, a temporally specific promoter, a developmentally specific promoter, and an inducible promoter.

Non-constitutive promoters suitable for use with the recombinant DNA constructs of the invention include spatially specific promoters, temporally specific promoters, and inducible promoters. Spatially specific promoters can include organelle-, cell-, tissue-, or organ-specific promoters (e.g., a plastid-specific, a root-specific, a pollen-specific, or a seed-specific promoter for suppressing expression of the first target RNA in plastids, roots, pollen, or seeds, respectively). In many cases a seed-specific, embryo-specific, aleurone-specific, or endosperm-specific promoter is especially useful. Temporally specific promoters can include promoters that tend to promote expression during certain developmental stages in a plant's growth cycle, or during different times of day or night, or at different seasons in a year. Inducible promoters include promoters induced by chemicals or by environmental conditions such as, but not limited to, biotic or abiotic stress (e.g., water deficit or drought, heat, cold, high or low nutrient or salt levels, high or low light levels, or pest or pathogen infection). Of particular interest are microRNA promoters, especially those having a temporally specific, spatially specific, or inducible expression pattern; examples of miRNA promoters, as well as methods for identifying miRNA promoters having specific expression patterns, are provided in U.S. Patent Application Publications 2006/0200878, 2007/0199095, and 2007/0300329, which are specifically incorporated herein by reference. An expression-specific promoter can also include promoters that are generally constitutively expressed but at differing degrees or "strengths" of expression, including promoters commonly regarded as "strong promoters" or as "weak promoters".

Promoters of particular interest include the following examples: an opaline synthase promoter isolated from T-DNA of *Agrobacterium*; a cauliflower mosaic virus 35S promoter; enhanced promoter elements or chimeric promoter elements such as an enhanced cauliflower mosaic virus (CaMV) 35S promoter linked to an enhancer element (an intron from heat shock protein 70 of *Zea mays*); root specific promoters such as those disclosed in U.S. Pat. Nos. 5,837, 848; 6,437,217 and 6,426,446; a maize L3 oleosin promoter disclosed in U.S. Pat. No. 6,433,252; a promoter for a plant nuclear gene encoding a plastid-localized aldolase disclosed in U.S. Patent Application Publication 2004/0216189; cold-inducible promoters disclosed in U.S. Pat. No. 6,084,089; salt-inducible promoters disclosed in U.S. Pat. No. 6,140,078; light-inducible promoters disclosed in U.S. Pat. No. 6,294,714; pathogen-inducible promoters disclosed in U.S. Pat. No. 6,252,138; and water deficit-inducible promoters disclosed in U.S. Patent Application Publication 2004/0123347 A1. All of the above-described patents and patent publications disclosing promoters and their use, especially in recombinant DNA constructs functional in plants are incorporated herein by reference.

Plant vascular- or phloem-specific promoters of interest include a rolC or rolA promoter of *Agrobacterium rhizogenes*, a promoter of a *Agrobacterium tumefaciens* T-DNA gene 5, the rice sucrose synthase RSs1 gene promoter, a Commelina yellow mottle badnavirus promoter, a coconut foliar decay virus promoter, a rice tungro bacilliform virus promoter, the promoter of a pea glutamine synthase GS3A gene, a invCD111 and invCD141 promoters of a potato invertase genes, a promoter isolated from *Arabidopsis* shown to have phloem-specific expression in tobacco by Kertbundit et al. (1991) *Proc. Natl. Acad. Sci. USA.*, 88:5212-5216, a VAHOX1 promoter region, a pea cell wall invertase gene promoter, an acid invertase gene promoter from carrot, a promoter of a sulfate transporter gene Sultr1;3, a promoter of a plant sucrose synthase gene, and a promoter of a plant sucrose transporter gene.

Promoters suitable for use with a recombinant DNA construct of this invention include polymerase II ("pol II") promoters and polymerase III ("pol III") promoters. RNA polymerase II transcribes structural or catalytic RNAs that are usually shorter than 400 nucleotides in length, and recognizes a simple run of T residues as a termination signal; it has been used to transcribe siRNA duplexes (see, e.g., Lu et al. (2004) *Nucleic Acids Res.*, 32:e171). Pol II promoters are therefore preferred in certain embodiments where a short RNA transcript is to be produced from a recombinant DNA construct of this invention. In one embodiment, the recombinant DNA construct includes a pol II promoter to express an RNA transcript flanked by self-cleaving ribozyme sequences (e.g., self-cleaving hammerhead ribozymes), resulting in a processed RNA, including single-stranded RNA that binds to the transcript of at least one target gene, with defined 5' and 3' ends, free of potentially interfering flanking sequences. An alternative approach uses pol III promoters to generate transcripts with relatively defined 5' and 3' ends, i.e., to transcribe an RNA with minimal 5' and 3' flanking sequences. In some embodiments, Pol III promoters (e.g., U6 or H1 promoters) are preferred for adding a short AT-rich transcription termination site that results in 2 base-pair overhangs (UU) in the transcribed RNA; this is useful, e.g., for expression of siRNA-type constructs. Use of pol III promoters for driving expression of siRNA constructs has been reported; see van de Wetering et al. (2003) *EMBO Rep.*, 4: 609-615, and Tuschl (2002) *Nature Biotechnol.*, 20: 446-448.

The promoter element can include nucleic acid sequences that are not naturally occurring promoters or promoter elements or homologues thereof but that can regulate expression of a gene. Examples of such "gene independent" regulatory sequences include naturally occurring or artificially designed RNA sequences that include a ligand-binding region or aptamer (see "Aptamers", below) and a regulatory region (which can be cis-acting). See, for example, Isaacs et al. (2004) *Nat. Biotechnol.*, 22:841-847, Bayer and Smolke (2005) *Nature Biotechnol.*, 23:337-343, Mandal and Breaker (2004) *Nature Rev. Mol. Cell Biol.*, 5:451-463, Davidson and Ellington (2005) *Trends Biotechnol.*, 23:109-112, Winkler et al. (2002) *Nature*, 419:952-956, Sudarsan et al. (2003) *RNA*, 9:644-647, and Mandal and Breaker (2004) *Nature Struct. Mol. Biol.*, 11:29-35. Such "riboregulators" could be selected or designed for specific spatial or temporal specificity, for example, to regulate translation of the DNA that undergoes processing to an RNA including single-stranded RNA that binds to the transcript of at least one target gene only in the presence (or absence) of a given concentration of the appropriate ligand. One example is a riboregulator that is responsive to an endogenous ligand (e.g., jasmonic acid or salicylic acid) produced by the plant when under stress (e.g., abiotic stress such as water, temperature, or nutrient stress, or biotic stress such as attach by pests or pathogens); under stress, the level of endogenous ligand increases to a level sufficient for the riboregulator to begin transcription of the DNA that undergoes processing to an RNA including single-stranded RNA that binds to the transcript of at least one target gene.

Aptamers

In some embodiments, the recombinant DNA construct of this invention includes DNA that is processed to an RNA aptamer, that is, an RNA that binds to a ligand through binding mechanism that is not primarily based on Watson-Crick base-pairing (in contrast, for example, to the base-pairing that occurs between complementary, anti-parallel nucleic acid strands to form a double-stranded nucleic acid structure). See, for example, Ellington and Szostak (1990) *Nature*, 346:818-822. Examples of aptamers can be found, for example, in the public Aptamer Database, available on line at aptamer.icmb.utexas.edu (Lee et al. (2004) *Nucleic Acids Res.*, 32(1): D95-100). Aptamers useful in the invention can, however, be monovalent (binding a single ligand) or multivalent (binding more than one individual ligand, e.g., binding one unit of two or more different ligands).

Ligands useful in the invention include any molecule (or part of a molecule) that can be recognized and be bound by a nucleic acid secondary structure by a mechanism not primarily based on Watson-Crick base pairing. In this way, the recognition and binding of ligand and aptamer is analogous to that of antigen and antibody, or of biological effector and receptor. Ligands can include single molecules (or part of a molecule), or a combination of two or more molecules (or parts of a molecule), and can include one or more macromolecular complexes (e.g., polymers, lipid bilayers, liposomes, cellular membranes or other cellular structures, or cell surfaces). Examples of specific ligands include vitamins such as coenzyme $B_{12}$ and thiamine pyrophosphate, flavin mononucleotide, guanine, adenosine, S-adenosylmethionine, S-adenosylhomocysteine, coenzyme A, lysine, tyrosine, dopamine, glucosamine-6-phosphate, caffeine, theophylline, antibiotics such as chloramphenicol and neomycin, herbicides such as glyphosate and dicamba, proteins including viral or phage coat proteins and invertebrate epidermal or digestive tract surface proteins, and RNAs including viral RNA, transfer-RNAs (t-RNAs), ribosomal RNA (rRNA), and RNA polymerases such as RNA-dependent RNA polymerase (RdRP). One class of RNA aptamers useful in the invention are "thermoswitches" that do not bind a ligand but are thermally responsive, that is to say, the aptamer's conformation is determined by temperature; see, for example, Box 3 in Mandal and Breaker (2004) *Nature Rev. Mol. Cell Biol.,* 5:451-463.

Transgene Transcription Units

In some embodiments, the recombinant DNA construct of this invention includes a transgene transcription unit. A transgene transcription unit includes DNA sequence encoding a gene of interest, e.g., a natural protein or a heterologous protein. A gene of interest can be any coding or non-coding sequence from any species (including, but not limited to, non-eukaryotes such as bacteria, and viruses; fungi, protists, plants, invertebrates, and vertebrates. Genes of interest include those genes also described above as target genes, under the heading "Target Genes". The transgene transcription unit can further include 5' or 3' sequence or both as required for transcription of the transgene.

Introns

In some embodiments, the recombinant DNA construct of this invention includes DNA encoding a spliceable intron. By "intron" is generally meant a segment of DNA (or the RNA transcribed from such a segment) that is located between exons (protein-encoding segments of the DNA or corresponding transcribed RNA), wherein, during maturation of the messenger RNA, the intron present is enzymatically "spliced out" or removed from the RNA strand by a cleavage/ligation process that occurs in the nucleus in eukaryotes. The term "intron" is also applied to non-coding DNA sequences that are transcribed to RNA segments that can be spliced out of a maturing RNA transcript, but are not introns found between protein-coding exons. One example of these are spliceable sequences that that have the ability to enhance expression in plants (in some cases, especially in monocots) of a downstream coding sequence; these spliceable sequences are naturally located in the 5' untranslated region of some plant genes, as well as in some viral genes (e.g., the tobacco mosaic virus 5' leader sequence or "omega" leader described as enhancing expression in plant genes by Gallie and Walbot (1992) *Nucleic Acids Res.,* 20:4631-4638). These spliceable sequences or "expression-enhancing introns" can be artificially inserted in the 5' untranslated region of a plant gene between the promoter but before any protein-coding exons. Examples of such expression-enhancing introns include, but are not limited to, a maize alcohol dehydrogenase (Zm-Adh1), a maize Bronze-1 expression-enhancing intron, a rice actin 1 (Os-Act1) intron, a Shrunken-1 (Sh-1) intron, a maize sucrose synthase intron, a heat shock protein 18 (hsp18) intron, and an 82 kilodalton heat shock protein (hsp82) intron. U.S. Pat. Nos. 5,593,874 and 5,859,347, specifically incorporated by reference herein, describe methods of improving recombinant DNA constructs for use in plants by inclusion of an expression-enhancing intron derived from the 70 kilodalton maize heat shock protein (hsp70) in the non-translated leader positioned 3' from the gene promoter and 5' from the first protein-coding exon.

Ribozymes

In some embodiments, the recombinant DNA construct of this invention includes DNA encoding one or more ribozymes. Ribozymes of particular interest include a self-cleaving ribozyme, a hammerhead ribozyme, or a hairpin ribozyme. In one embodiment, the recombinant DNA construct includes DNA encoding one or more ribozymes that serve to cleave the transcribed RNA to provide defined segments of RNA, such as the single-stranded RNA that binds to the target gene transcript.

Recombinases

In some embodiments, the recombinant DNA construct of this invention includes DNA encoding one or more site-specific recombinase recognition sites. In one embodiment, the recombinant DNA construct includes at least a pair of loxP sites, wherein site-specific recombination of DNA between the loxP sites is mediated by a Cre recombinase. The position and relative orientation of the loxP sites is selected to achieve the desired recombination; for example, when the loxP sites are in the same orientation, the DNA between the loxP sites is excised in circular form. In another embodiment, the recombinant DNA construct includes DNA encoding one loxP site; in the presence of Cre recombinase and another DNA with a loxP site, the two DNAs are recombined.

Gene Suppression Elements

In some embodiments, the recombinant DNA construct of this invention further includes DNA encoding a gene suppression element. Gene suppression elements include any DNA sequence (or RNA sequence encoded therein) designed to specifically suppress a gene or genes of interest, which can be a gene endogenous to the cell in which the recombinant DNA construct is transcribed, or a gene exogenous to that cell. The gene to be suppressed can be any of those disclosed as target genes under the heading "Target Genes".

Suitable gene suppression elements are described in detail in U.S. Patent Application Publication 2006/0200878, which disclosure is specifically incorporated herein by reference, and include one or more of:

(a) DNA that includes at least one anti-sense DNA segment that is anti-sense to at least one segment of the gene to be suppressed;

(b) DNA that includes multiple copies of at least one anti-sense DNA segment that is anti-sense to at least one segment of the gene to be suppressed e;

(c) DNA that includes at least one sense DNA segment that is at least one segment of the gene to be suppressed;

(d) DNA that includes multiple copies of at least one sense DNA segment that is at least one segment of the gene to be suppressed;

(e) DNA that transcribes to RNA for suppressing the gene to be suppressed by forming double-stranded RNA and includes at least one anti-sense DNA segment that is anti-sense to at least one segment of the gene to be suppressed and at least one sense DNA segment that is at least one segment of the gene to be suppressed;

(f) DNA that transcribes to RNA for suppressing the gene to be suppressed by forming a single double-stranded RNA and includes multiple serial anti-sense DNA segments that are anti-sense to at least one segment of the gene to be suppressed and multiple serial sense DNA segments that are at least one segment of the gene to be suppressed;

(g) DNA that transcribes to RNA for suppressing the gene to be suppressed by forming multiple double strands of RNA and includes multiple anti-sense DNA segments that are anti-sense to at least one segment of the gene to be suppressed and multiple sense DNA segments that are at least one segment of the gene to be suppressed, and wherein the multiple anti-sense DNA segments and the multiple sense DNA segments are arranged in a series of inverted repeats;

(h) DNA that includes nucleotides derived from a plant miRNA;

(i) DNA that includes nucleotides of a siRNA;

(j) DNA that transcribes to an RNA aptamer capable of binding to a ligand; and (k) DNA that transcribes to an RNA aptamer capable of binding to a ligand, and DNA that transcribes to regulatory RNA capable of regulating expression of the gene to be suppressed, wherein the regulation is dependent on the conformation of the regulatory RNA, and the conformation of the regulatory RNA is allosterically affected by the binding state of the RNA aptamer.

In some embodiments, an intron is used to deliver a gene suppression element in the absence of any protein-coding exons (coding sequence). In one example, an intron, such as an expression-enhancing intron (preferred in certain embodiments), is interrupted by embedding within the intron a gene suppression element, wherein, upon transcription, the gene suppression element is excised from the intron. Thus, protein-coding exons are not required to provide the gene suppressing function of the recombinant DNA constructs disclosed herein.

Transcription Regulatory Elements

In some embodiments, the recombinant DNA construct of this invention includes DNA encoding a transcription regulatory element. Transcription regulatory elements include elements that regulate the expression level of the recombinant DNA construct of this invention (relative to its expression in the absence of such regulatory elements). Examples of suitable transcription regulatory elements include riboswitches (cis- or trans-acting), transcript stabilizing sequences, and miRNA recognition sites, as described in detail in U.S. Patent Application Publication 2006/0200878, specifically incorporated herein by reference.

Making and Using Recombinant DNA Constructs

The recombinant DNA constructs of this invention are made by any method suitable to the intended application, taking into account, for example, the type of expression desired and convenience of use in the plant in which the construct is to be transcribed. General methods for making and using DNA constructs and vectors are well known in the art and described in detail in, for example, handbooks and laboratory manuals including Sambrook and Russell, "Molecular Cloning: A Laboratory Manual" (third edition), Cold Spring Harbor Laboratory Press, NY, 2001. An example of useful technology for building DNA constructs and vectors for transformation is disclosed in U.S. Patent Application Publication 2004/0115642 A1, specifically incorporated herein by reference. DNA constructs can also be built using the GATEWAY™ cloning technology (available from Invitrogen Life Technologies, Carlsbad, Calif.), which uses the site-specific recombinase LR cloning reaction of the Integrase/att system from bacteriophage lambda vector construction, instead of restriction endonucleases and ligases. The LR cloning reaction is disclosed in U.S. Pat. Nos. 5,888,732 and 6,277,608, and in U.S. Patent Application Publications 2001/283529, 2001/282319 and 2002/0007051, all of which are specifically incorporated herein by reference. Another alternative vector fabrication method employs ligation-independent cloning as disclosed by Aslandis et al. (1990) *Nucleic Acids Res.*, 18:6069-6074 and Rashtchian et al. (1992) *Biochem.*, 206:91-97, where a DNA fragment with single-stranded 5' and 3' ends is ligated into a desired vector which can then be amplified in vivo.

In certain embodiments, the DNA sequence of the recombinant DNA construct includes sequence that has been codon-optimized for the plant in which the recombinant DNA construct is to be expressed. For example, a recombinant DNA construct to be expressed in a plant can have all or parts of its sequence (e.g., the first gene suppression element or the gene expression element) codon-optimized for expression in a plant by methods known in the art. See, e.g., U.S. Pat. No. 5,500,365, incorporated by reference, for a description of codon-optimization methodology for plants; see also De Amicis and Marchetti (2000) *Nucleic Acid Res.*, 28:3339-3346.

Non-Natural Transgenic Plant Cells, Plants, and Seeds

In another aspect, this invention provides a non-natural transgenic plant cell having in its genome a recombinant DNA construct of this invention including DNA that undergoes processing to an RNA including single-stranded RNA that binds to the transcript of at least one target gene to form a hybridized segment of at least partially double-stranded RNA that imparts to the transcript resistance to cleavage by an RNase III ribonuclease within or in the vicinity of the hybridized segment. This invention further provides a non-natural transgenic plant including the non-natural transgenic plant cell. In one embodiment, the non-natural transgenic plant is wholly composed of transgenic tissue. In another embodiment, the non-natural plant is a partially transgenic plant and includes non-transgenic tissue; in one example, the non-natural partially transgenic plant includes a non-transgenic scion and a transgenic rootstock including the non-natural transgenic plant cell. Further provided by this invention is a non-natural transgenic seed including the non-natural transgenic plant cell.

A non-natural transgenic plant of this invention includes plants of any developmental stage, and includes a non-natural regenerated plant prepared from the non-natural transgenic plant cells disclosed herein, or a non-natural progeny plant (which can be an inbred or hybrid progeny plant) of the regenerated plant, or seed of such a non-natural transgenic plant. Also provided is a non-natural transgenic seed having in its genome a recombinant DNA construct of this invention. The non-natural transgenic plant cells, transgenic plants, and transgenic seeds of this invention are made by methods well-known in the art, as described below under the heading "Making and Using Transgenic Plant Cells and Transgenic Plants".

The non-natural transgenic plant cell can include an isolated plant cell (e.g., individual plant cells or cells grown in or on an artificial culture medium), or can include a plant cell in undifferentiated tissue (e.g., callus or any aggregation of plant cells). The non-natural transgenic plant cell can include a plant cell in at least one differentiated tissue selected from the group consisting of leaf (e.g., petiole and blade), root, stem (e.g., tuber, rhizome, stolon, bulb, and corm) stalk (e.g., xylem, phloem), wood, seed, fruit, and flower (e.g., stamen, filament, anther, pollen, microspore, carpel, pistil, ovary, ovules). The non-natural transgenic plant cell or non-natural transgenic plant of the invention can be stably transformed, e.g., fertile transgenic plants and their non-natural transgenic seed also containing the recombinant construct of this invention.

In some embodiments of this invention, the non-natural plant is a non-natural transgenic plant. In such embodiments, all cells (with the possible exception of haploid cells) and tissues of the non-natural plant contain the recombinant DNA construct of this invention. In other embodiments, the non-natural plant is partially transgenic, and includes natural non-transgenic tissue (for example, non-natural transgenic tissue grafted onto natural non-transgenic tissue). In one embodiment, the non-natural plant includes a natural non-transgenic scion and a non-natural transgenic rootstock including the transgenic plant cell, wherein the non-transgenic scion and transgenic rootstock are grafted together. Such embodiments are particularly useful where the plant is one that is commonly vegetatively grown as a scion grafted onto a rootstock (wherein scion and rootstock can be of the same species or variety or of different species or variety); examples include grapes, apples, pears, quince, avocados, citrus, stone fruits, kiwifruit, roses, and other plants of agricultural or ornamental importance. Specifically claimed embodiments include embodiments where (a) the non-natural partially transgenic plant includes a natural non-transgenic grape scion and a non-natural transgenic grape rootstock; and (b) the non-natural partially transgenic plant includes a natural non-transgenic fruit tree (e.g., pear) scion and a non-natural transgenic fruit tree (e.g., quince) rootstock.

Making and Using Transgenic Plant Cells and Transgenic Plants

Where a recombinant DNA construct of this invention is used to produce a non-natural transgenic plant cell, plant, or seed of this invention, transformation can include any of the well-known and demonstrated methods and compositions. Suitable methods for plant transformation include virtually any method by which DNA can be introduced into a cell. One method of plant transformation is microprojectile bombardment, for example, as illustrated in U.S. Pat. Nos. 5,015,580 (soybean), 5,538,880 (maize), 5,550,318 (maize), 5,914,451 (soybean), 6,153,812 (wheat), 6,160,208 (maize), 6,288,312 (rice), 6,365,807 (rice), and 6,399,861 (maize), and 6,403,865 (maize), all of which are incorporated by reference for enabling the production of transgenic plants.

Another useful method of plant transformation is *Agrobacterium*-mediated transformation by means of *Agrobacterium* containing a binary Ti plasmid system, wherein the *Agrobacterium* carries a first Ti plasmid and a second, chimeric plasmid containing at least one T-DNA border of a wild-type Ti plasmid, a promoter functional in the transformed plant cell and operably linked to a gene suppression construct of the invention. See, for example, the binary system described in U.S. Pat. No. 5,159,135, incorporated by reference. Also see De Framond (1983) *Biotechnology*, 1:262-269; and Hoekema et al., (1983) *Nature*, 303:179. In such a binary system, the smaller plasmid, containing the T-DNA border or borders, can be conveniently constructed and manipulated in a suitable alternative host, such as *E. coli*, and then transferred into *Agrobacterium*.

Detailed procedures for *Agrobacterium*-mediated transformation of plants, especially crop plants, include procedures disclosed in U.S. Pat. Nos. 5,004,863, 5,159,135, and 5,518,908 (cotton); 5,416,011, 5,569,834, 5,824,877 and 6,384,301 (soybean); 5,591,616 and 5,981,840 (maize); 5,463,174 (brassicas including canola), 7,026,528 (wheat), and 6,329,571 (rice), and in U.S. Patent Application Publications 2004/0244075 (maize) and 2001/0042257 A1 (sugar beet), all of which are specifically incorporated by reference for enabling the production of transgenic plants. Similar methods have been reported for many plant species, both dicots and monocots, including, among others, peanut (Cheng et al. (1996) *Plant Cell Rep.*, 15: 653); asparagus (Bytebier et al. (1987) *Proc. Natl. Acad. Sci. U.S.A.*, 84:5345); barley (Wan and Lemaux (1994) *Plant Physiol.*, 104:37); rice (Toriyama et al. (1988) *Bio/Technology*, 6:10; Zhang et al. (1988) *Plant Cell Rep.*, 7:379; wheat (Vasil et al. (1992) *Bio/Technology*, 10:667; Becker et al. (1994) *Plant J.*, 5:299), alfalfa (Masoud et al. (1996) *Transgen. Res.*, 5:313); and tomato (Sun et al. (2006) *Plant Cell Physiol.*, 47:426-431). See also a description of vectors, transformation methods, and production of transformed *Arabidopsis thaliana* plants where transcription factors are constitutively expressed by a CaMV35S promoter, in U.S. Patent Application Publication 2003/0167537 A1, incorporated by reference. Various methods of transformation of other plant species are well known in the art, see, for example, the encyclopedic reference, "Compendium of Transgenic Crop Plants", edited by Chittaranjan Kole and Timothy C. Hall, Blackwell Publishing Ltd., 2008; ISBN 978-1-405-16924-0 (available electronically at mrw.interscience.wiley.com/emrw/9781405181099/hpt/toc), which describes transformation procedures for cereals and forage grasses (rice, maize, wheat, barley, oat, sorghum, pearl millet, finger millet, cool-season forage grasses, and bahiagrass), oilsee crops (soybean, oilseed brassicas, sunflower, peanut, flax, sesame, and safflower), legume grains and forages (common bean, cowpea, pea, faba bean, lentil, tepary bean, Asiatic beans, pigeonpea, vetch, chickpea, lupin, alfalfa, and clovers), temperate fruits and nuts (apple, pear, peach, plums, berry crops, cherries, grapes, olive, almond, and Persian walnut), tropical and subtropical fruits and nuts (citrus, grapefruit, banana and plantain, pineapple, papaya, mango, avocado, kiwifruit, passionfruit, and persimmon), vegetable crops (tomato, eggplant, peppers, vegetable brassicas, radish, carrot, cucurbits, alliums, asparagus, and leafy vegetables), sugar, tuber, and fiber crops (sugarcane, sugar beet, stvia, potato, sweet potato, cassava, and cotton), plantation crops, ornamentals, and turf grasses (tobacco, coffee, cocoa, tea, rubber tree, medicinal plants, ornamentals, amd turf grasses), and forest tree species One of ordinary skill in the art has various transformation methodologies for production of stable transgenic plants.

Transformation methods to provide transgenic plant cells and transgenic plants containing stably integrated recombinant DNA are preferably practiced in tissue culture on media and in a controlled environment. "Media" refers to the numerous nutrient mixtures that are used to grow cells in vitro, that is, outside of the intact living organism. Recipient cell targets include, but are not limited to, meristem cells, callus, immature embryos or parts of embryos, and gametic cells such as microspores, pollen, sperm, and egg cells. Any cell from which a fertile plant can be regenerated is contemplated as a useful recipient cell for practice of the invention. Callus can be initiated from various tissue sources, including, but not limited to, immature embryos or parts of embryos, seedling apical meristems, microspores, and the like. Those cells which are capable of proliferating as callus can serve as recipient cells for genetic transformation. Practical transformation methods and materials for making transgenic plants of this invention (e.g., various media and recipient target cells, transformation of immature embryos, and subsequent regeneration of fertile transgenic plants) are disclosed, for example, in U.S. Pat. Nos. 6,194,636 and 6,232,526 and U.S. Patent Application Publication 2004/0216189, which are specifically incorporated by reference.

In general transformation practice, DNA is introduced into only a small percentage of target cells in any one transformation experiment. Marker genes are generally used to provide an efficient system for identification of those cells that are stably transformed by receiving and integrating a transgenic DNA construct into their genomes. Preferred marker genes provide selective markers which confer resistance to a selective agent, such as an antibiotic or herbicide. Any of the antibiotics or herbicides to which a plant cell may be resistant can be a useful agent for selection. Potentially transformed cells are exposed to the selective agent. In the population of surviving cells will be those cells where, generally, the resistance-conferring gene is integrated and expressed at sufficient levels to permit cell survival. Cells can be tested further to confirm stable integration of the recombinant DNA. Commonly used selective marker genes include those conferring resistance to antibiotics such as kanamycin or paromomycin (nptII), hygromycin B (aph IV) and gentamycin (aac3 and aacC4) or resistance to herbicides such as glufosinate (bar or pat) and glyphosate (EPSPS). Examples of useful selective marker genes and selection agents are illustrated in U.S. Pat. Nos. 5,550,318, 5,633,435, 5,780,708, and 6,118,047, all of which are specifically incorporated by reference. Screenable markers or reporters, such as markers that provide an ability to visually identify transformants can also be employed. Examples of useful screenable markers include, for example, a gene expressing a protein that produces a detectable color by acting on a chromogenic substrate (e.g., beta glucuronidase (GUS) (uidA) or luciferase (luc)) or that itself is detectable, such as green fluorescent protein (GFP) (gfp) or an immunogenic molecule. Those of skill in the art will recognize that many other useful markers or reporters are available for use.

Detecting or measuring transcription of the recombinant DNA construct in the transgenic plant cell of the invention can be achieved by any suitable method, including protein detection methods (e.g., western blots, ELISAs, and other immunochemical methods), measurements of enzymatic activity, or nucleic acid detection methods (e.g., Southern blots, northern blots, PCR, RT-PCR, fluorescent in situ hybridization).

Other suitable methods for detecting or measuring transcription of the recombinant DNA construct in the transgenic plant cell of the invention include measurement of any other trait that is a direct or proxy indication of the level of expression of the target gene in the transgenic plant cell in which the recombinant DNA construct is transcribed, relative to the level of expression in one in which the recombinant DNA is not transcribed, e.g., gross or microscopic morphological traits, growth rates, yield, reproductive or recruitment rates, resistance to pests or pathogens, or resistance to biotic or abiotic stress (e.g., water deficit stress, salt stress, nutrient stress, heat or cold stress). Such methods can use direct measurements of a phenotypic trait or proxy assays (e.g., in plants, these assays include plant part assays such as leaf or root assays to determine tolerance of abiotic stress). Such methods include direct measurements of resistance to an invertebrate pest or pathogen (e.g., damage to plant tissues) or proxy assays (e.g., plant yield assays, or bioassays such as the Western corn rootworm (*Diabrotica virgifera virgifera* LeConte) larval bioassay described in International Patent Application Publication WO2005/110068 A2 and U.S. Patent Application Publication US 2006/0021087 A1, specifically incorporated by reference, or the soybean cyst nematode bioassay described by Steeves et al. (2006) *Funct. Plant Biol.,* 33:991-999, wherein cysts per plant, cysts per gram root, eggs per plant, eggs per gram root, and eggs per cyst are measured.

The recombinant DNA constructs of the invention can be stacked with other recombinant DNA for imparting additional traits (e.g., in the case of transformed plants, traits including herbicide resistance, pest resistance, cold germination tolerance, water deficit tolerance, and the like) for example, by expressing or suppressing other genes. Constructs for coordinated decrease and increase of gene expression are disclosed in U.S. Patent Application Publication 2004/0126845 A1, specifically incorporated by reference.

Seeds of fertile transgenic plants can be harvested and used to grow progeny generations, including hybrid generations, of transgenic plants of this invention that include the recombinant DNA construct in their genome. Thus, in addition to direct transformation of a plant with a recombinant DNA construct of this invention, transgenic plants of the invention can be prepared by crossing a first plant having the recombinant DNA with a second plant lacking the construct. For example, the recombinant DNA can be introduced into a plant line that is amenable to transformation to produce a transgenic plant, which can be crossed with a second plant line to introgress the recombinant DNA into the resulting progeny. A transgenic plant of the invention can be crossed with a plant line having other recombinant DNA that confers one or more additional trait(s) (such as, but not limited to, herbicide resistance, pest or disease resistance, environmental stress resistance, modified nutrient content, and yield improvement) to produce progeny plants having recombinant DNA that confers both the desired target sequence expression behavior and the additional trait(s).

In such breeding for combining traits the transgenic plant donating the additional trait can be a male line (pollinator) and the transgenic plant carrying the base traits can be the female line. The progeny of this cross segregate such that some of the plant will carry the DNA for both parental traits and some will carry DNA for one parental trait; such plants can be identified by markers associated with parental recombinant DNA Progeny plants carrying DNA for both parental traits can be crossed back into the female parent line multiple times, e.g., usually 6 to 8 generations, to produce a homozygous progeny plant with substantially the same genotype as one original transgenic parental line as well as the recombinant DNA of the other transgenic parental line.

Yet another aspect of the invention is a transgenic plant grown from the transgenic seed of the invention. This invention contemplates transgenic plants grown directly from transgenic seed containing the recombinant DNA as well as progeny generations of plants, including inbred or hybrid plant lines, made by crossing a transgenic plant grown directly from transgenic seed to a second plant not grown from the same transgenic seed. Crossing can include, for example, the following steps:

(a) plant seeds of the first parent plant (e.g., non-transgenic or a transgenic) and a second parent plant that is transgenic according to the invention;
(b) grow the seeds of the first and second parent plants into plants that bear flowers;
(c) pollinate a flower from the first parent with pollen from the second parent; and
(d) harvest seeds produced on the parent plant bearing the fertilized flower.

It is often desirable to introgress recombinant DNA into elite varieties, e.g., by backcrossing, to transfer a specific desirable trait from one source to an inbred or other plant that lacks that trait. This can be accomplished, for example, by first crossing a superior inbred ("A") (recurrent parent) to a donor inbred ("B") (non-recurrent parent), which carries the appropriate gene(s) for the trait in question, for example, a construct prepared in accordance with the current invention. The progeny of this cross first are selected in the resultant progeny for the desired trait to be transferred from the non-recurrent parent "B", and then the selected progeny are mated back to the superior recurrent parent "A". After five or more backcross generations with selection for the desired trait, the progeny can be essentially hemizygous for loci controlling the characteristic being transferred, but are like the superior parent for most or almost all other genes. The last backcross generation would be selfed to give progeny which are pure breeding for the gene(s) being transferred, i.e., one or more transformation events.

Through a series of breeding manipulations, a selected DNA construct can be moved from one line into an entirely different line without the need for further recombinant manipulation. One can thus produce inbred plants which are true breeding for one or more DNA constructs. By crossing different inbred plants, one can produce a large number of different hybrids with different combinations of DNA constructs. In this way, plants can be produced which have the desirable agronomic properties frequently associated with hybrids ("hybrid vigor"), as well as the desirable characteristics imparted by one or more DNA constructs.

In certain transgenic plant cells and transgenic plants of the invention, it may be desirable to concurrently express a gene of interest while also modulating expression of a target gene. Thus, in some embodiments, the transgenic plant contains recombinant DNA further including a gene expression element for expressing at least one gene of interest, and transcription of the recombinant DNA construct of this invention is preferably effected with concurrent transcription of the gene expression element.

The recombinant DNA constructs of this invention can be transcribed in any plant cell or tissue or in a whole plant of any developmental stage. Transgenic plants can be derived from any monocot or dicot plant, such as, but not limited to, plants of commercial or agricultural interest, such as crop plants (especially crop plants used for human food or animal feed), wood- or pulp-producing trees, vegetable plants, fruit plants, and ornamental plants. Examples of plants of interest include grain crop plants (such as wheat, oat, barley, maize, rye, triticale, rice, millet, sorghum, quinoa, amaranth, and buckwheat); forage crop plants (such as forage grasses and forage dicots including alfalfa, vetch, clover, and the like); oilseed crop plants (such as cotton, safflower, sunflower, soybean, canola, rapeseed, flax, peanuts, and oil palm); tree nuts (such as walnut, cashew, hazelnut, pecan, almond, and the like); sugarcane, coconut, date palm, olive, sugarbeet, tea, and coffee; wood- or pulp-producing trees; vegetable crop plants such as legumes (for example, beans, peas, lentils, alfalfa, peanut), lettuce, asparagus, artichoke, celery, carrot, radish, the brassicas (for example, cabbages, kales, mustards, and other leafy brassicas, broccoli, cauliflower, Brussels sprouts, turnip, kohlrabi), edible cucurbits (for example, cucumbers, melons, summer squashes, winter squashes), edible alliums (for example, onions, garlic, leeks, shallots, chives), edible members of the Solanaceae (for example, tomatoes, eggplants, potatoes, peppers, groundcherries), and edible members of the Chenopodiaceae (for example, beet, chard, spinach, quinoa, amaranth); fruit crop plants such as apple, pear, citrus fruits (for example, orange, lime, lemon, grapefruit, and others), stone fruits (for example, apricot, peach, plum, nectarine), banana, pineapple, grape, kiwifruit, papaya, avocado, and berries; plants grown for biomass or biofuel (for example, *Miscanthus* grasses, switchgrass, jatropha, oil palm, eukaryotic microalgae such as *Botryococcus braunii*, *Chlorella* spp., and *Dunaliella* spp., and eukaryotic macroalgae such as *Gracilaria* spp., and *Sargassum* spp.); and ornamental plants including ornamental flowering plants, ornamental trees and shrubs, ornamental groundcovers, and ornamental grasses.

This invention also provides commodity products produced from a non-natural transgenic plant cell, plant, or seed of this invention, including, but not limited to, harvested leaves, roots, shoots, tubers, stems, fruits, seeds, or other parts of a plant, meals, oils, extracts, fermentation or digestion products, crushed or whole grains or seeds of a plant, or any food or non-food product including such commodity products produced from a transgenic plant cell, plant, or seed of this invention. The detection of one or more of nucleic acid sequences of the recombinant DNA constructs of this invention in one or more commodity or commodity products contemplated herein is de facto evidence that the commodity or commodity product contains or is derived from a non-natural transgenic plant cell, plant, or seed of this invention.

In various embodiments, the non-natural transgenic plant having in its genome a recombinant DNA construct of this invention has at least one additional altered trait, relative to a plant lacking the recombinant DNA construct, selected from the group of traits consisting of:

(a) improved abiotic stress tolerance;
(b) improved biotic stress tolerance;
(c) modified primary metabolite composition;
(d) modified secondary metabolite composition;
(e) modified trace element, carotenoid, or vitamin composition;
(f) improved yield;
(g) improved ability to use nitrogen, phosphate, or other nutrients;
(h) modified agronomic characteristics;
(i) modified growth or reproductive characteristics; and
(j) improved harvest, storage, or processing quality.

In some embodiments, the non-natural transgenic plant is characterized by: improved tolerance of abiotic stress (e.g., tolerance of water deficit or drought, heat, cold, non-optimal nutrient or salt levels, non-optimal light levels) or of biotic stress (e.g., crowding, allelopathy, or wounding); by a modified primary metabolite (e.g., fatty acid, oil, amino acid, protein, sugar, or carbohydrate) composition; a modified secondary metabolite (e.g., alkaloids, terpenoids, polyketides, non-ribosomal peptides, and secondary metabolites of mixed biosynthetic origin) composition; a modified trace element (e.g., iron, zinc), carotenoid (e.g., beta-carotene, lycopene, lutein, zeaxanthin, or other carotenoids and xanthophylls), or vitamin (e. g., tocopherols) composition; improved yield (e.g., improved yield under non-stress conditions or improved yield under biotic or abiotic stress); improved ability to use nitrogen, phosphate, or other nutrients; modified agronomic characteristics (e.g., delayed ripening; delayed senescence; earlier or later maturity; improved shade tolerance; improved resistance to root or stalk lodging; improved resistance to "green snap" of stems; modified photoperiod response); modified growth or reproductive characteristics (e.g., intentional dwarfing; intentional male sterility, useful, e.g., in improved hybridization procedures; improved vegetative growth rate; improved germination; improved male or female fertility); improved harvest, storage, or processing quality (e.g., improved resistance to pests during storage, improved resistance to breakage, improved appeal to consumers); or any combination of these traits.

In another embodiment, non-natural transgenic seed, or seed produced by the non-natural transgenic plant, has modified primary metabolite (e.g., fatty acid, oil, amino acid, protein, sugar, or carbohydrate) composition, a modified secondary metabolite composition, a modified trace element, carotenoid, or vitamin composition, an improved harvest, storage, or processing quality, or a combination of these. In another embodiment, it can be desirable to change levels of native components of the transgenic plant or seed of a transgenic plant, for example, to decrease levels of an allergenic protein or glycoprotein or of a toxic metabolite.

Generally, screening a population of transgenic plants each regenerated from a transgenic plant cell is performed to identify transgenic plant cells that develop into transgenic plants having the desired trait. The transgenic plants are assayed to detect an enhanced trait, e.g., enhanced water use efficiency, enhanced cold tolerance, increased yield, enhanced nitrogen use efficiency, enhanced seed protein, and enhanced seed oil. Screening methods include direct screening for the trait in a greenhouse or field trial or screening for a surrogate trait. Such analyses are directed to detecting changes in the chemical composition, biomass, physiological properties, or morphology of the plant. Changes in chemical compositions such as nutritional composition of grain are detected by analysis of the seed composition and content of protein, free amino acids, oil, free fatty acids, starch, tocopherols, or other nutrients. Changes in growth or biomass characteristics are detected by measuring plant height, stem diameter, internode length, root and shoot dry weights, and (for grain-producing plants such as maize, rice, or wheat) ear or seed head length and diameter. Changes in physiological properties are identified by evaluating responses to stress conditions, e.g., assays under imposed stress conditions such as water deficit, nitrogen or phosphate deficiency, cold or hot growing conditions, pathogen or insect attack, light deficiency, or increased plant density. Other selection properties include days to pollen shed, days to silking in maize, leaf extension rate, chlorophyll content, leaf temperature, stand, seedling vigor, internode length, plant height, leaf number, leaf area, tillering, brace roots, staying green, stalk lodging, root lodging, plant health, fertility, green snap, and pest resistance. In addition, phenotypic characteristics of harvested seed may be evaluated; for example, in maize this can include the number of kernels per row on the ear, number of rows of kernels on the ear, kernel abortion, kernel weight, kernel size, kernel density and physical grain quality. The following illustrates examples of screening assays useful for identifying desired traits in maize plants. These can be readily adapted for screening other plants such as canola, cotton, and soybean either as hybrids or inbreds.

Transgenic maize plants having nitrogen use efficiency are identified by screening in fields with three levels of nitrogen fertilizer being applied, e.g. low level (0 pounds/acre), medium level (80 pounds/acre) and high level (180 pounds/acre). Plants with enhanced nitrogen use efficiency provide higher yield as compared to control plants.

Transgenic maize plants having enhanced yield are identified by screening the transgenic plants over multiple locations with plants grown under optimal production management practices and maximum weed and pest control. A useful target for improved yield is a 5% to 10% increase in yield as compared to yield produced by plants grown from seed for a control plant. Selection methods may be applied in multiple and diverse geographic locations and over one or more planting seasons to statistically distinguish yield improvement from natural environmental effects.

Transgenic maize plants having enhanced water use efficiency are identified by screening plants in an assay where water is withheld for period to induce stress followed by watering to revive the plants. For example, a useful selection process imposes 3 drought/re-water cycles on plants over a total period of 15 days after an initial stress free growth period of 11 days. Each cycle consists of 5 days, with no water being applied for the first four days and a water quenching on the 5th day of the cycle. The primary phenotypes analyzed by the selection method are the changes in plant growth rate as determined by height and biomass during a vegetative drought treatment.

Transgenic maize plants having enhanced cold tolerance are identified by screening plants in a cold germination assay and/or a cold tolerance field trial. In a cold germination assay trays of transgenic and control seeds are placed in a dark growth chamber at 9.7 degrees Celsius for 24 days. Seeds having higher germination rates as compared to the control are identified as having enhanced cold tolerance. In a cold tolerance field trial plants with enhanced cold tolerance are identified from field planting at an earlier date than conventional spring planting for the field location. For example, seeds are planted into the ground around two weeks before local farmers begin to plant maize so that a significant cold stress is exerted onto the crop. As a control, seeds also are planted under local optimal planting conditions such that the crop has little or no exposure to cold condition. At each location, seeds are planted under both cold and normal conditions preferably with multiple repetitions per treatment.

The foregoing description and the examples presented in this disclosure describe the subject matter of this invention, which includes the following: (I) a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment; (II) a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment, wherein said processing of DNA to an RNA comprising single-stranded RNA comprises transcription of said DNA to an RNA intermediate comprising one or more double-stranded RNA stems; (III) a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment, wherein length of said single-stranded RNA comprises between about 10 to about 100 nucleotides; (IV) a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment, further comprising at least one element selected from the group consisting of: (A) promoter functional in a eukaryotic cell; (B) a Pol III promoter operably linked to said DNA that undergoes processing to an RNA comprising single-stranded RNA; (C) DNA that is processed to an RNA aptamer; (D) a transgene transcription unit; (E) DNA encoding a spliceable intron; (F) DNA encoding a self-splicing ribozyme; (G) DNA encoding a site-specific recombinase recognition site; (H) DNA encoding a gene suppression element; and (I) DNA encoding a transcription regulatory element; (V) a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment, wherein said at least one target gene comprises: (A) coding sequence, non-coding sequence, or both coding and non-coding sequence; or (B) a single target gene, or multiple target genes; or (C) one or more of the group consisting of: (1) an endogenous gene of a eukaryote, (2) a transgene of a transgenic plant, (3) an endogenous gene of a pest or pathogen of a plant, and (4) an endogenous gene of a symbiont associated with a pest or pathogen of a plant; (VI) a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment, wherein said binding of said single-stranded RNA to said transcript: (A) inhibits double-stranded RNA-mediated suppression of said at least one target gene; or (B) inhibits translation of said transcript; (VII) a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment, wherein said binding of said single-stranded RNA to said transcript: (A) inhibits double-stranded RNA-mediated suppression of said at least one target gene; or (B) inhibits translation of said transcript; and wherein: (1) said binding of said single-stranded RNA to said transcript inhibits double-stranded RNA-mediated suppression of said at least one target gene and the length of said hybridized segment comprises between about 10 to about 100 base pairs; (2) said binding of said single-stranded RNA to said transcript inhibits translation of said transcript and the length of said hybridized segment comprises between about 10 to about 50 base pairs; or (3) said binding of said single-stranded RNA to said transcript inhibits translation of said transcript and the length of said hybridized segment comprises between about 19 to about 50 base pairs, said hybridized segment comprises smaller segments of 9 or fewer contiguous, perfectly complementary base pairs, and at least one mismatch or insertion is between each pair of said smaller segments; (VIII) a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment, wherein said binding of said single-stranded RNA to said transcript: (A) inhibits double-stranded RNA-mediated suppression of said at least one target gene; or (B) inhibits translation of said transcript; and wherein said binding of said single-stranded RNA to said transcript inhibits double-stranded RNA-mediated suppression of said at least one target gene and the length of said hybridized segment comprises between about 10 to about 100 base pairs, and said double-stranded RNA-mediated suppression comprises cleavage of said transcript by said RNase III ribonuclease, and said cleavage is mediated by binding of a small RNA to said transcript; (IX) a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment, wherein said binding of said single-stranded RNA to said transcript: (A) inhibits double-stranded RNA-mediated suppression of said at least one target gene; or (B) inhibits translation of said transcript; and wherein said small RNA is: (1) an endogenous small RNA or a transgenic small RNA; or (2) selected from the group consisting of a miRNA, an siRNA, a trans-acting siRNA, a phased small RNA, a natural antisense transcript siRNA, and a natural antisense transcript miRNA; (X) a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment, wherein said binding of said single-stranded RNA to said transcript: (A) inhibits double-stranded RNA-mediated suppression of said at least one target gene; or (B) inhibits translation of said transcript; and wherein said binding of said single-stranded RNA to said transcript inhibits double-stranded RNA-mediated suppression of said at least one target gene and the length of said hybridized segment comprises between about 10 to about 100 base pairs, and said double-stranded RNA-mediated suppression comprises cleavage of said transcript by said RNase III ribonuclease, and said cleavage is mediated by binding of a small RNA to said transcript; and wherein said hybridized segment comprises at least one mismatch or at least one insertion in said hybridized segment at a position that results in inhibiting cleavage of said transcript by said RNase III ribonuclease; (XI) a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment, wherein said binding of said single-stranded RNA to said transcript: (A) inhibits double-stranded RNA-mediated suppression of said at least one target gene; or (B) inhibits translation of said transcript; and wherein said binding of said single-stranded RNA to said transcript inhibits double-stranded RNA-mediated suppression of said at least one target gene and the length of said hybridized segment comprises between about 10 to about 100 base pairs, and said double-stranded RNA-mediated suppression comprises cleavage of said transcript by said RNase III ribonuclease, and said cleavage is mediated by binding of a small RNA to said transcript; and wherein said small RNA is a mature miRNA, said binding is at a miRNA recognition site in said transcript, said cleavage of said transcript occurs at said miRNA recognition site, and said hybridized segment is formed at least partially within said miRNA recognition site; (XII) a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment, wherein said binding of said single-stranded RNA to said transcript: (A) inhibits double-stranded RNA-mediated suppression of said at least one target gene; or (B) inhibits translation of said transcript; and wherein said binding of said single-stranded RNA to said transcript inhibits double-stranded RNA-mediated suppression of said at least one target gene and the length of said hybridized segment comprises between about 10 to about 100 base pairs, and said double-stranded RNA-mediated suppression comprises cleavage of said transcript by said RNase III ribonuclease, and said cleavage is mediated by binding of a small RNA to said transcript; and wherein said small RNA is a mature miRNA, said binding is at a miRNA recognition site in said transcript, said cleavage of said transcript occurs at said miRNA recognition site, and said hybridized segment is formed at least partially within said miRNA recognition site; and wherein said hybridized segment comprises: (1) at least one mismatch between said single-stranded RNA and said miRNA recognition site at positions corresponding to positions 9, 10, or 11 of said mature miRNA, or (2) at least one insertion at a position in said single-stranded RNA at positions corresponding to positions 10-11 of said mature miRNA, or (3) an A, G, or C (but not a U) at a position corresponding to the 5' terminus of said mature miRNA, but does not include (a) mismatches between said single-stranded RNA and said miRNA recognition site at positions of said miRNA recognition site corresponding to positions 9, 10, or 11 (in 3' to 5' direction) of said mature miRNA, or (b) insertions at a position in said single-stranded RNA at positions of said miRNA recognition site corresponding to positions 10 or 11 (in 3' to 5' direction) of said mature miRNA; (XIII) a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment, wherein said binding of said single-stranded RNA to said transcript: (A) inhibits double-stranded RNA-mediated suppression of said at least one target gene; or (B) inhibits translation of said transcript; and wherein said binding of said single-stranded RNA to said transcript inhibits translation of said transcript, and said binding of said single-stranded RNA to said transcript occurs: (i) at least partially within the 5' untranslated region or 3' untranslated region of said transcript; or (ii) within or in the vicinity of the start codon or of the 5' cap; (XIV) a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment, wherein said binding of said single-stranded RNA to said transcript: (A) inhibits double-stranded RNA-mediated suppression of said at least one target gene; or (B) inhibits translation of said transcript; and wherein said binding of said single-stranded RNA to said transcript inhibits translation of said transcript, and said hybridized segment is resistant to cleavage by said RNase III ribonuclease; (XV) a method of modulating expression of a target gene, comprising expressing in a cell a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment; (XVI) a method of modulating expression of a target gene, comprising expressing in a cell a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment; and wherein said binding of said single-stranded RNA to said transcript: (A) inhibits double-stranded RNA-mediated suppression of said at least one target gene, thereby increasing expression of said target gene; or (B) inhibits translation of said transcript, thereby decreasing expression of said target gene; (XVII) a non-natural plant chromosome or plastid comprising a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment; (XVIII) a non-natural transgenic plant cell having in its genome a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment, or a non-natural transgenic plant or a non-natural transgenic plant seed or a non-natural transgenic pollen grain comprising said non-natural transgenic plant cell; (XIX) a non-natural partially transgenic plant comprising: (A) a non-natural transgenic plant cell having in its genome a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment and further comprising non-transgenic tissue: or (B) a transgenic rootstock comprising a non-natural transgenic plant cell having in its genome a recombinant DNA construct comprising DNA that undergoes processing to an RNA comprising single-stranded RNA that binds to the transcript of at least one target gene to form a hybridized segment of at least partially double-stranded RNA that imparts to said transcript resistance to cleavage by an RNase III ribonuclease within or in the vicinity of said hybridized segment and further comprising a non-transgenic scion; (XX) a recombinant DNA construct transcribable in a plant cell, comprising a promoter that is functional in said plant cell and operably linked to at least one polynucleotide selected from: (A) DNA encoding a cleavage blocker to prevent or decrease small RNA-mediated cleavage of the transcript of at least one miRNA target identified in Tables 2 or 3; (B) DNA encoding a 5'-modified cleavage blocker to prevent or decrease small RNA-mediated cleavage of the transcript of at least one miRNA target identified in Tables 2 or 3; (C) DNA encoding a translational inhibitor to prevent or decrease small RNA-mediated cleavage of the transcript of at least one miRNA target identified in Tables 2 or 3; (D) DNA encoding a decoy to prevent or decrease small RNA-mediated cleavage of the transcript of at least one miRNA target identified in Tables 2 or 3; (E) DNA encoding a miRNA-unresponsive transgene having a nucleotide sequence derived from the native nucleotide sequence of at least one miRNA target identified in Tables 2 or 3, wherein a miRNA recognition site in said native nucleotide sequence is deleted or otherwise modified to prevent miRNA-mediated cleavage; (F) DNA encoding a miRNA precursor which is processed into a miRNA for suppressing expression of at least one miRNA target identified in Tables 2 or 3; (G) DNA encoding double-stranded RNA which is processed into siRNAs for suppressing expression of at least one miRNA target identified in Tables 2 or 3; and (H) DNA encoding a ta-siRNA which is processed into siRNAs for suppressing expression of at least one miRNA target identified in Tables 2 or 3; (XXI) a recombinant DNA construct transcribable in a plant cell, comprising a promoter that is functional in said plant cell and operably linked to at least one polynucleotide selected from: (A) DNA encoding a cleavage blocker to prevent or decrease small RNA-mediated cleavage of the transcript of at least one miRNA target identified in Tables 2 or 3; (B) DNA encoding a 5'-modified cleavage blocker to prevent or decrease small RNA-mediated cleavage of the transcript of at least one miRNA target identified in Tables 2 or 3; (C) DNA encoding a translational inhibitor to prevent or decrease small RNA-mediated cleavage of the transcript of at least one miRNA target identified in Tables 2 or 3; (D) DNA encoding a decoy to prevent or decrease small RNA-mediated cleavage of the transcript of at least one miRNA target identified in Tables 2 or 3; (E) DNA encoding a miRNA-unresponsive transgene having a nucleotide sequence derived from the native nucleotide sequence of at least one miRNA target identified in Tables 2 or 3, wherein a miRNA recognition site in said native nucleotide sequence is deleted or otherwise modified to prevent miRNA-mediated cleavage; (F) DNA encoding a miRNA precursor which is processed into a miRNA for suppressing expression of at least one miRNA target identified in Tables 2 or 3; (G) DNA encoding double-stranded RNA which is processed into siRNAs for suppressing expression of at least one miRNA target identified in Tables 2 or 3; and (H) DNA encoding a ta-siRNA which is processed into siRNAs for suppressing expression of at least one miRNA target identified in Tables 2 or 3; and wherein said at least one miRNA target identified in Tables 2 or 3 is at least one selected from the group consisting of a miR156 target, a miR160 target, a miR164 target, a miR166 target, a miR167 target, a miR169 target, a miR171 target, a miR172 target, a miR319 target, miR395 target, a miR396 target, a a miR398 target, a miR399 target, a miR408 target, a miR444 target, a miR528 target, a miR167g target, a miR169g target, COP1 (constitutive photomorphogenesis1), GA2ox (gibberellic acid 2 oxidase), GA20ox (gibberellic acid 20 oxidase), HB2 (homeobox 2), HB2-4 (homeobox 2 and homeobox 4), HB4 (homeobox 4), LG1 (liguleless1), SPX (SYG1, PHO81 and XPR1 domain; PFAM entry PF03105 at www.sanger.ac.uk), VIM1a (variant in methylation 1a), DHS1 (deoxyhypusine synthase), DHS2 (deoxyhypusine synthase), DHS3 (deoxyhypusine synthase), DHS4 (deoxyhypusine synthase), DHS5 (deoxyhypusine synthase), DHS6 (deoxyhypusine synthase), DHS7 (deoxyhypusine synthase), DHS8 (deoxyhypusine synthase), CRF (corn RING finger; RNF169), G1543a (maize orthologue of *Arabidopsis thaliana* homeobox 17), G1543b (maize orthologue of *Arabidopsis thaliana* homeobox 17), GS3 (grain size 3), and GW2 (grain weight 2); (XXII) a recombinant DNA construct transcribable in a plant cell, comprising a promoter that is functional in said plant cell and operably linked to at least one polynucleotide selected from: (A) DNA encoding a cleavage blocker to prevent or decrease small RNA-mediated cleavage of the transcript of at least one miRNA target identified in Tables 2 or 3; (B) DNA encoding a 5'-modified cleavage blocker to prevent or decrease small RNA-mediated cleavage of the transcript of at least one miRNA target identified in Tables 2 or 3; (C) DNA encoding a translational inhibitor to prevent or decrease small RNA-mediated cleavage of the transcript of at least one miRNA target identified in Tables 2 or 3; (D) DNA encoding a decoy to prevent or decrease small RNA-mediated cleavage of the transcript of at least one miRNA target identified in Tables 2 or 3; (E) DNA encoding a miRNA-unresponsive transgene having a nucleotide sequence derived from the native nucleotide sequence of at least one miRNA target identified in Tables 2 or 3, wherein a miRNA recognition site in said native nucleotide sequence is deleted or otherwise modified to prevent miRNA-mediated cleavage; (F) DNA encoding a miRNA precursor which is processed into a miRNA for suppressing expression of at least one miRNA target identified in Tables 2 or 3; (G) DNA encoding double-stranded RNA which is processed into siRNAs for suppressing expression of at least one miRNA target identified in Tables 2 or 3; and (H) DNA encoding a ta-siRNA which is processed into siRNAs for suppressing expression of at least one miRNA target identified in Tables 2 or 3; and wherein said at least one miRNA target identified in Tables 2 or 3 is at least one selected from the group consisting of a miR156 target, a miR160 target, a miR164 target, a miR166 target, a miR167 target, a miR169 target, a miR171 target, a miR172 target, a miR319 target, miR395 target, a miR396 target, a a miR398 target, a miR399 target, a miR408 target, a miR444 target, a miR528 target, a miR167g target, a miR169g target, COP1 (constitutive photomorphogenesis1), GA2ox (gibberellic acid 2 oxidase), GA20ox (gibberellic acid 20 oxidase), HB2 (homeobox 2), HB2-4 (homeobox 2 and homeobox 4), HB4 (homeobox 4), LG1 (liguleless1), SPX (SYG1, PHO81 and XPR1 domain; PFAM entry PF03105 at www.sanger.ac.uk), VIM1a (variant in methylation 1a), DHS1 (deoxyhypusine synthase), DHS2 (deoxyhypusine synthase), DHS3 (deoxyhypusine synthase), DHS4 (deoxyhypusine synthase), DHS5 (deoxyhypusine synthase), DHS6 (deoxyhypusine synthase), DHS7 (deoxyhypusine synthase), DHS8 (deoxyhypusine synthase), CRF (corn RING finger; RNF169), G1543a (maize orthologue of *Arabidopsis thaliana* homeobox 17), G1543b (maize orthologue of *Arabidopsis thaliana* homeobox 17), GS3 (grain size 3), and GW2 (grain weight 2); and wherein said at least one polynucleotide is at least one selected from the group consisting of DNA encoding a nucleotide sequence selected from SEQ ID NOs: 1120, 1121, 1122, 1248, 1257, 1313, 1314, 1364, 1387, 1478, 1489, 1490, 1491, 1492, 1493, 1585, 1597, 1598, 1599, 1713, 1752, 1753, 1801, 1802, 1820, 1927, 1929, 1931, 1971, 2006, 2007, 2008, 2010, 2012, 2014, 2016, 2018, 2022, 2023, 2025, 2027, 2029, 2031, 2033, 2035, 2037, 2039, 2041, 2043, 2045, 2047, 2049, 2051, 2053, 2055, 2056, 2057, 2059, 2060, 2061, and 2063; and (XXIII) a recombinant DNA construct transcribable in a plant cell, comprising a promoter that is functional in said plant cell and operably linked to at least one polynucleotide selected from: (A) DNA encoding a cleavage blocker to prevent or decrease small RNA-mediated cleavage of the transcript of at least one miRNA target identified in Tables 2 or 3; (B) DNA encoding a 5'-modified cleavage blocker to prevent or decrease small RNA-mediated cleavage of the transcript of at least one miRNA target identified in Tables 2 or 3; (C) DNA encoding a translational inhibitor to prevent or decrease small RNA-mediated cleavage of the transcript of at least one miRNA target identified in Tables 2 or 3; (D) DNA encoding a decoy to prevent or decrease small RNA-mediated cleavage of the transcript of at least one miRNA target identified in Tables 2 or 3; (E) DNA encoding a miRNA-unresponsive transgene having a nucleotide sequence derived from the native nucleotide sequence of at least one miRNA target identified in Tables 2 or 3, wherein a miRNA recognition site in said native nucleotide sequence is deleted or otherwise modified to prevent miRNA-mediated cleavage; (F) DNA encoding a miRNA precursor which is processed into a miRNA for suppressing expression of at least one miRNA target identified in Tables 2 or 3; (G) DNA encoding double-stranded RNA which is processed into siRNAs for suppressing expression of at least one miRNA target identified in Tables 2 or 3; and (H) DNA encoding a ta-siRNA which is processed into siRNAs for suppressing expression of at least one miRNA target identified in Tables 2 or 3; amd wherein said recombinant DNA construct is stably integrated into a plastid or a chromosome of said plant cell.

EXAMPLES

Example 1

This example illustrates the making and using of a "cleavage blocker" recombinant DNA construct including DNA that undergoes processing to an RNA including single-stranded RNA that binds to the transcript of at least one target gene to form a hybridized segment of at least partially double-stranded RNA that imparts to the transcript resistance to cleavage by an RNase III ribonuclease within or in the vicinity of the hybridized segment, wherein the binding of the single-stranded RNA to the transcript (and the resultant formation of the hybridized segment) inhibits double-stranded RNA-mediated suppression of a target gene. More specifically, this example describes constructs for producing in planta an artificial or engineered miRNA or a cleavage blocker and use of the cleavage blocker to inhibit miRNA-mediated suppression of an *Arabidopsis* GL1 gene in transformed plant cells.

Target gene: The *Arabidopsis* GLABROUS1 (GL1) gene is required for trichome synthesis; GL1 mutants lack leaf trichomes. GL1 is encoded by the DNA sequence ATGAGAATAAGGAGAAGAGATGAAAAA-GAGAATCAAGAATACAAGAAAGGTTTATGGACA GTTGAAGAAGACAACATCCTTATGGAC-TATGTTCTTAATCATGGCACTGGCCAATGGAACCG CATCGTCAGAAAAACTGGGCTAAA-GAGATGTGGGAAAAGTTGTAGACT-GAGATGGATGAAT TATTTGAGCCCTAATGTGAA-CAAAGGCAATTTCACTGAACAAGAAGAAGACCTC-ATTATTCG TCTCCACAAGCTCCTCGGCAATAGATG-GTCTTTGATAGCTAAAAGAGTACCGGGAAGAACA GATAACCAAGTCAAGAACTACTGGAA-CACTCATCTCAGCAAAAAACTCGTCGGAGATTACT CCTCCGCCGTCAAAACCACCGGAGAA-GACGACGACTCTCCACCGTCATTGTTCATCACTGCC GCCACACCTTCTTCTTGTCATCATCAA-CAAGAAAATATCTACGAGAATATAGCCAAGAGCTT TAACGGCGTCGTATCAGCTTCGTACGAG-GATAAACCAAAACAAGAACTGGCTCAAAAAGAT GTCCTAATGGCAACTACTAATGATC-CAAGTCACTATTATGGCAATAACGCTT-TATGGGTTCA TGACGACGATTTTGAGCTTAGT-TCACTCGTAATGATGAATTTTGCTTCTGGTGATGTT-GAGTA CTGCCTTTAG (SEQ ID NO: 1), includes a miRNA recognition site, which has the sequence CTCCAC-CGTCATTGTTCATCA (SEQ ID NO: 2) and which is also indicated by the underlined text at nucleotide positions 404 to 424 of SEQ ID NO: 1.

MicroRNA: Selected as a scaffold or initial sequence for designing an artificial miRNA was DNA derived from a soybean"miRMON1" precursor having the sequence AAT-TCATTACATTGATAAAACACAAT-TCAAAAGATCAATGTTCCACTTCATGCAAAGACATT TCCAAAATATGTGTAGGTAGAGGGGTTT-TACAGGATCGTCC<u>TGAGACCAAATGAGCAGCTGAC</u>-CACATGATGCAGCTATGTTTGCTAT-TCAGCTGCTCATCTGTTCTCAGGTCGCCCTTGTTGG ACTGTCCAACTCCTACTGATTGCGGATG-CACTTGCCACAAATGAAAATCAAAGCGAGGGGA AAAGAATGTAGAGTGTGACTACGATTG-CATGCATGTGATTTAGGTAATTAAGTTACATGATT GTCTAATTGTGTTTATGGAATTGTATA (SEQ ID NO: 3), where nucleotides of the mature miRNA ("miRMON1") are indicated by underlined text at nucleotide positions 104 to 124 of SEQ ID NO: 3. The encoded transcript was predicted to have the fold-back structure depicted in FIG. 1A, and is a segment of a longer miRMON1 precursor having the sequence AAAATTCATTACATTGATAAAACACAAT-TCAAAAGATCAATGTTCCACTTCATGCAAAGACA TTTCCAAAATATGTGTAGGTA-GAGGGGTTTTACAGGATCGTCC <u>TGAGACCAAATGAGCAGCTGA</u>CCACATGATGCAG-CTATGTTTGCTATTCAGCTGCTCATCT-GTTCTCAGGTCGCCCTTGTTG GACTGTCCAACTC-CTACTGATTGCGGATGCACTTGCCA-CAAATGAAAATCAAAGCGAGGGG AAAAGAATGTAGAGTGTGACTACGATTG-CATGCATGTGATTTAGGTAATTAAGTTACATGAT TGTCTAATTGTGTTTATGGAATTG-TATATTTTCAGACCAGGCACCTGTAAC-TAATTATAGGTA CCATACCTTAAAATAAGTCCAAC-TAAGTCCATGTCTGTGATTTTTTAGTGTCACAAATC-ACA ATCCATTGCCATTGGTTTTT-TAATTTTTCATTGTCTGTTGTTTAAC-TAACTCTAGCTTTTTAGC TGCTTCAAGTACAGATTC-CTCAAAGTGGAAAATGTTCTTTGAAGTCAATAAAA-AGAGCTTTG ATGATCATCTGCATTGTCTAAGTTG-GATAAACTAATTA-GAGAGAACTTTTGAACTTTGTCTA CCAAATATCT-GTCAGTGTCATCTGTCAGTTCTGCAAGCTGAAGTG-TTGAATCCACGAGGTGC TTGTTGCAAAGTTGT-GATATTAAAAGACATCTACGAAGAAGT-TCAAGCAAAACTCTTTTTGG C (SEQ ID NO: 4), where nucleotides of the mature miRMON1 are indicated by underlined text at nucleotide positions 106 to 126 of SEQ ID NO: 4; this longer miRMON1 precursor was previously disclosed as SEQ ID NO: 38 in U.S. patent application Ser. No. 11/303, 745, published as U.S. Patent Application Publication 2006/200878, and is specifically incorporated herein by reference). The longer precursor (SEQ ID NO: 4) is also suitable as a scaffold.

DNA encoding an engineered "miRGL1" miRNA precursor derived from SEQ ID NO: 3 was designed to produce an engineered miRGL1 precursor transcript that is processed to an artificial "miRGL1" mature miRNA for suppressing the *Arabidopsis* endogenous gene, GL1. The miRGL1 precursor had the sequence AATTCATTACATTGATAAAACACAAT-TCAAAAGATCAATGTTCCACTTCATGCAAAGACATT TCCAAAATATGTGTAGGTAGAGGGGTTT-TACAGGATCGTCC<u>TGATGAACAATGACGGTGGAGC</u>-CACATGATGCAGCTATGTTTGCTATCTC-CACCGTCATCGTCCATCAGGTCGCCCTTGTTGGA CTGTCCAACTCCTACTGATTGCGGATG-CACTTGCCACAAATGAAAATCAAAGCGAGGGGAA AAGAATGTAGAGTGTGACTACGATTG-CATGCATGTGATTTAGGTAATTAAGTTACATGATTG TCTAATTGTGTTTATGGAATTGTATA (SEQ ID NO: 5), where nucleotides of the mature miRNA ("miRGL1") are indicated by underlined text at nucleotide positions 104 to 124 of SEQ ID NO: 5 and nucleotides of the corresponding opposite strand designated miRNA* ("miRGL1*") are indicated by italicized text at nucleotide positions 151 to 171 of SEQ ID NO: 5. This miRGL1 precursor was predicted to have the fold-back structure depicted in FIG. 1B and is processed in planta to the mature miRGL1, which has the sequence (in 5' to 3' direction) TGATGAACAATGACGGTGGAG (SEQ ID NO: 6, alternatively written in 3' to 5' direction as GAG-GTGGCAGTAACAAGTAGT).

Cleavage Blocker: DNA encoding a cleavage blocker ("miRGL1-CB") precursor derived from SEQ ID NO: 3 was designed to transcribe to an engineered "cleavage blocker"-type miRNA precursor that is processed to an RNA including single-stranded RNA that binds to the transcript of the target gene GL1 to form a hybridized segment of at least partially double-stranded RNA that imparts to the GL1 transcript resistance to cleavage by an RNase III ribonuclease within or in the vicinity of the hybridized segment, wherein the binding of the single-stranded RNA to the transcript (and the resultant formation of the hybridized segment) inhibits double-stranded RNA-mediated suppression of the at least one target gene, wherein the suppression is mediated by miRGL1. The miRGL1-CB precursor had the sequence AATTCATTACAT-TGATAAAACACAATTCAAAAGATCAAT-GTTCCACTTCATGCAAAGACATT TCCAAAATATGT-GTAGGTAGAGGGGTTTTACAGGATCGTCC
<u>TGATGAACATAGACGGTGGAG</u>CCACATGATGCAGC-TATGTTTGCTATCTCCACCGTCTACGTC-CATCAGGTCGCCCTTGTTGGA CTGTCCAACTC-CTACTGATTGCGGATGCACTTGCCA-CAAATGAAAATCAAAGCGAGGGGAA AAGAATGTAGAGTGTGACTACGATTG-CATGCATGTGATTTAGGTAATTAAGTTACATGATTG TCTAATTGTGTTTATGGAATTGTATA (SEQ ID NO: 7), where nucleotides of the mature cleavage blocker ("miRGL1-CB") are indicated by underlined text at nucleotide positions 104 to 124 of SEQ ID NO: 7 and nucleotides of the corresponding opposite strand miRNA* ("miRGL1-CB*") are indicated by italicized text at nucleotide positions 151 to 171 of SEQ ID NO: 7. Nucleotides at positions 113 and 114 of SEQ ID NO: 7 are indicated by bold underlined text and correspond to positions 10 and 11 (in 3' to 5' direction) of the mature miRGL1-CB1; these two nucleotides were selected to be intentionally mismatched to nucleotides of the miRNA recognition site (SEQ ID NO: 2) of GL1 (SEQ ID NO: 1) to prevent cleavage by an RNase III ribonuclease. The encoded miRGL1-CB RNA precursor was predicted to have the fold-back structure depicted in FIG. 1C and is processed in planta to the mature miRGL1-CB, which has the sequence (in 5' to 3' direction) TGATGAACATAGACGGTGGAG (SEQ ID NO: 8, alternatively written in 3' to 5' direction as GAGGTGGCA-GATACAAGTAGT). FIG. 1E depicts an alignment of the GL1 miRNA recognition site (SEQ ID NO: 2), the mature miRGL1 in 3' to 5' direction (SEQ ID NO: 6), and the mature miRGL1-CB in 3' to 5' direction (SEQ ID NO: 8).

miRGL1 Sensor: DNA encoding a "miRGL1-sensor" having the sequence TccagctgctcatttggtctcaTGAT-CACTGCGGCCGCAATACAgccatagatcacttgatgtcaC <u>GAccaccgtcattgttcatca</u>gatttctctctgcaagcg (SEQ ID NO: 9) was designed to include an artificial miRGL1 recognition site having the sequence <u>G</u>ACCACCGTCATTGTTCATCA (SEQ ID NO: 10), which is also indicated by underlined text at nucleotide positions 67 and 87 of SEQ ID NO: 9. Nucleotides at positions 67 and 68 of SEQ ID NO: 9 (or nucleotides at positions 1 and 2 of SEQ ID NO: 10) are indicated by bold underlined text and correspond to positions 1 and 2 (in 3' to 5' direction) of the mature miRGL1; these two nucleotides were selected to be intentionally mismatched to the last two nucleotides on the 3' end of the mature miRGL1 (SEQ ID NO: 6) to prevent transitivity.

Three plasmids for *Agrobacterium*-mediated transformation were constructed:
(1) "35S/miRGL1/Term"—this plasmid included a construct containing, in 5' to 3' direction, (a) a 35S promoter driving expression of (b) a miRGL1 precursor (SEQ ID NO: 5), and (c) a nos terminator;
(2) "35S/GFP/miRGL1-sensor/Term"—this plasmid included a construct containing, in 5' to 3' direction, (a) a 35S promoter operably linked to (b) a green fluorescent protein (GFP) coding sequence, (c) a miRGL1-sensor sequence (SEQ ID NO: 9), and (d) a nos terminator;
(3) "35S/miRGL1-CB"—this plasmid included a construct containing, in 5' to 3' direction, (a) a $^{35}$S promoter driving expression of (b) a miRGL1-CB precursor (SEQ ID NO: 7).

An aspect of this invention was demonstrated using protocols described in Kościańska et al. (2005) *Plant Mol. Biol.*, 59:647-661). *Nicotiana benthamiana* plants were transiently transformed using *Agrobacterium* with various combinations of these plasmids and, where necessary, "filler" (null plasmid) *Agrobacterium* to ensure infiltration of equal amounts of *Agrobacterium*.

*Nicotiana benthamiana* plants transformed with plasmid (2) exhibited GFP (green) fluorescence when visualized under UV light. In plants transformed with plasmids (1) and (2), GFP fluorescence was abolished with only chlorophyll (red) fluorescence observed under UV light, indicating that the mature miRGL1 microRNA suppressed expression of GFP. In plants transformed with plasmids (1), (2) and (3), GFP fluorescence was restored, indicating that the miRGL1-CB cleavage blocker inhibited double-stranded RNA-mediated (i.e., mRGL1-mediated) suppression of the target gene GFP by protecting the miRGL1 recognition site from being cleaved by the mature miRGL1, resulting in increased expression (fluorescence) of the target gene GFP relative to its expression in the absence of the cleavage blocker.

In another demonstration of this invention, stably transformed *Arabidopsis thaliana* plants were produced by *Agrobacterium*-mediated transformation with a plasmid expressing a miRGL1 precursor (SEQ ID NO: 5), which is processed in planta to a "miRGL1" mature miRNA for suppressing the *Arabidopsis* endogenous gene, GL1. The resulting transformed *Arabidopsis* plants exhibited leaves without trichomes, indicating suppression of the target gene GLABROUS1. *Arabidopsis* plants homozygous for miRGL1 DNA are further transformed with a plasmid expressing a miRGL1-CB precursor (SEQ ID NO: 7) and selected using kanamycin resistance. In these double transformant plants, in planta expression of the mature cleavage blocker miRGL1-CB (in 3' to 5' direction, SEQ ID NO: 8) inhibits double-stranded RNA-mediated (i.e., mRGL1-mediated) suppression of the target gene GLABROUS1 (GL1) by protecting the miRGL1 recognition site from being cleaved by the mature miRGL1, resulting in restoration of trichome production (indicating increased expression of the target gene GL1 relative to its expression in the absence of the cleavage blocker).

Example 2

This example illustrates an alternative "cleavage blocker" recombinant DNA construct having modification at a position corresponding to the 5' terminus of the mature miRNA that natively binds to the recognition site of the target gene, i.e., a "5'-modified cleavage blocker" that is transgenically produced in planta and a method of use of this cleavage blocker to inhibit miRNA-mediated suppression of a target gene in transformed plant cells.

In one example, DNA encoding an artificial miRNA (miRGL1) precursor (SEQ ID NO: 6) was modified by a single nucleotide change (changing the 5' terminus of the mature miRGL1 from a U to a C) to yield the 5'-modified cleavage blocker precursor sequence AATTCATTACAT-TGATAAAACACAATTCAAAAGATCAAT-GTTCCACTTCATGCAAAGACATT TCCAAAATATGT-GTAGGTAGAGGGGTTTTACAGGATCGTCC CGATGAACAATGACGGTGGAGCCACATGATGCAG-CTATGTTTGCTATCTCCACCGT-CATCGTCCATCGGGTCGCCCTTGTTGG ACTGTC-CAACTCCTACTGATTGCGGATGCACT-TGCCACAAATGAAAATCAAAGCGAGGGGA AAAGAATGTAGAGTGTGACTACGATTG-CATGCATGTGATTTAGGTAATTAAGTTACATGATT GTCTAATTGTGTTTATGGAATTGTATA (SEQ ID NO: 11), where nucleotides of the mature 5'-modified cleavage blocker are indicated by underlined text at nucleotide positions 104 to 124 of SEQ ID NO: 11 (for comparison, nucleotides of SEQ ID NO: 11 that correspond to miRGL1* nucleotides in SEQ ID NO: 6 are indicated by italicized text at nucleotide positions 151 to 171 of SEQ ID NO: 11). This 5'-modified cleavage blocker RNA precursor was predicted to have the fold-back structure depicted in FIG. 1D and is processed in planta to the mature 5'-modified cleavage blocker, which has the sequence (in 5' to 3' direction) CGATGAA-CAATGACGGTGGAG (SEQ ID NO: 12, alternatively written in 3' to 5' direction as GAGGTGGCAGTAACAAG-TAGC). Nicotiana benthaminiana was transiently transfected using procedures similar to those described in Example 2. The resulting mature small RNA processed from this 5'-modified cleavage blocker RNA precursor was unexpectedly observed to function as a cleavage blocker, inhibiting miRGL1-mediated suppression of the target gene GFP.

Two 5'-modified variants of the miRGL1-CB precursor (SEQ ID NO: 7) were made, wherein the position corresponding to the 5' terminus of the mature miRGL1-CB was changed from a T to an A or from a T to a C, respectively, but wherein the mismatches corresponding to positions 10 or 11 (in 3' to 5' direction) of the mature miRGL1 were preserved. Both variants were predicted to have a fold-back structure (not shown) similar to those shown in FIGS. 1A through 1D. The "5'-A variant" had the nucleotide sequence AATTCATTACAT-TGATAAAACACAATTCAAAAGATCAAT-GTTCCACTTCATGCAAAGACATT TCCAAAATATGT-GTAGGTAGAGGGGTTTTACAGGATCGTCC AGATGAACATAGACGGTGGAGCCACATGATGCAG-CTATGTTTGCTATCTCCACCGTCTACGTCCATC TGGTCGCCCTTGTTGGA CTGTCCAACTCCTACT-GATTGCGGATGCACTTGCCACAAAT-GAAAATCAAAGCGAGGGGAA AAGAATGTAGAGT-GTGACTACGATTGCATGCATGTGATTTAGGTAATTA-AGTTACATGATTG TCTAATTGTGTTTATGGAATTG-TATA (SEQ ID NO: 13) and the "5'-C variant" had the nucleotide sequence AATTCATTACATTGATAAAACACAAT-TCAAAAGATCAATGTTCCACTTCATGCAAAGACATT TCCAAAATATGTGTAGGTAGAGGGGTTT-TACAGGATCGTCC CGATGAACATAGACGGTGGAGCCACATGATGCAGC-TATGTTTGCTATCTCCACCGTCTACGTCCATC TGGTCGCCCTTGTTGGA CTGTCCAACTCCTACT-GATTGCGGATGCACTTGCCACAAAT-GAAAATCAAAGCGAGGGGAA AAGAATGTAGAGT-GTGACTACGATTGCATGCATGTGATTTAGGTAATTA-AGTTACATGATTG TCTAATTGTGTTTATGGAATTG-TATA (SEQ ID NO: 14), where nucleotides of the mature cleavage blocker are indicated by underlined text at nucleotide positions 104 to 124 of SEQ ID NO: 13 or of SEQ ID NO: 14 (for comparison, nucleotides of SEQ ID NO: 13 or of SEQ ID NO: 14 that correspond to miRGL1* nucleotides in SEQ ID NO: 6 are indicated by italicized text at nucleotide positions 151 to 171 of SEQ ID NO: 13 or of SEQ ID NO: 14).

The "5'-C variant" (SEQ ID NO: 14) was transiently transfected into Nicotiana benthaminiana (using procedures similar to those of Example 2); co-inoculation of the "5'-C" variant and 35S/miRGL1-sensor/Term (without miRGL1) resulted in GFP fluorescence, indicating that the "5'-C variant" was unable to cleave the miRGL1 recognition site and did not have miRNA-like activity.

Both the "5'-A variant" (SEQ ID NO: 13) (plasmid pMON115363) and the "5'-C variant" (SEQ ID NO: 14) (plasmid pMON115349) were tested using transient transfection of Nicotiana benthaminiana (similar to the experiment described in Example 2), and found to also inhibit miRGL1-mediated suppression of the target gene GFP, although not to as great an extent as the original cleavage blocker miRGL1-CB (SEQ ID NO: 7).

The above example serves as guidance in making and using a cleavage blocker (or 5'-modified cleavage blocker) useful for inhibiting miRNA-mediated suppression of a target gene. It is clear to one of ordinary skill in the art that knowledge of the target gene itself is not required, merely the sequence of the mature miRNA sequence or of a miRNA precursor that is processed to the mature miRNA—or, alternatively, knowledge of the miRNA recognition site sequence—in combination with the teachings of this application, in order to devise a cleavage blocker (or 5'-modified cleavage blocker) to inhibit the target gene silencing effects of a given miRNA.

Thus, this application further provides and claims novel cleavage blockers and 5'-modified cleavage blockers for all miRNA sequences that have been publicly disclosed, including, but not limited to, the miRNAs available at miRBase (microrna.sanger.ac.uk), and the mature miRNAs and miRNA precursors disclosed in U.S. patent application Ser. Nos. 11/303,745 (published as U.S. Patent Application Publication 2006/0200878), 11/974,469 (published as U.S. Patent Application Publication 2009-0070898 A1), 11/868,081 (published as U.S. Patent Application Publication 2008/0115240), 10/884,374 (published as U.S. Patent Application Publication 2005/0144669), and 10/490,955 (now U.S. Pat. No. 7,232,806), which patent application disclosures including the respective sequence listings are specifically incorporated by reference herein.

Example 3

This example provides embodiments of target genes identified as "validated miRNA targets" (i.e., containing a validated miRNA recognition site). Recombinant DNA constructs of this invention are useful for modulating expression of such target genes and for making non-natural transgenic plant cells, plant tissues, and plants (especially non-natural transgenic crop plants) having improved yield or other desirable traits.

Prediction of a recognition site is achieved using methods known in the art, such as sequence complementarity rules as described by Zhang (2005) Nucleic Acids Res., 33:W701-704 and by Rhoades et al. (2002) Cell, 110:513-520. One method to experimentally validate predicted miRNA recognition sites is the technique known as RNA ligase-mediated rapid amplification of cDNA 5' ends ("5' RLM-RACE" or "5' RACE"), which identifies miRNA cleavage patterns; see, for example, Kasschau et al. (2003) Dev. Cell, 4:205-217, and Llave et al. (2002) Science, 297:2053-2056. This approach relies on ligation of an RNA adapter molecule to the 5' end of the cleavage site and is dependent on the 5' phosphate left by RNase III enzymes including Ago 1. The resulting PCR products are sequenced and the relative number of clones which align to the predicted miRNA cleavage site between nucleotides 10 and 11 relative to the miRNA 5' end provide an estimate of miRNA activity.

While the standard for validation of a predicted miRNA target is experimental verification of the predicted cleavage, computational validation is also extremely useful for providing a set of potential target genes that is of manageable or practical size. At least two computational validation approaches based on homology of miRNAs and predicted miRNA targets can be used. One approach compares the predicted targets with experimentally verified targets; the predicted target is computationally validated if it is homologous to an experimentally validated target. This approach is expected to identify miRNA targets with high confidence and to become increasingly important as more experimentally validated targets become available. The second approach compares sequences from two species when no known miRNA target information is available. If both miRNAs and predicted miRNA targets are conserved in both species, then predicted targets in both species are deemed validated.

In this example, the first approach was used, wherein computational validation of predicted miRNA targets was based on homology of predicted targets and known targets. A list of experimentally verified plant miRNA target genes was created through mining the literature on miRNA targets from rice (Sunkar et al. (2005) *Plant Cell,* 17:1397-1411; Luo et al. (2006) *FEBS Lett.,* 580:5111-5116), moss (*Physcomitrella patens*) (Axtell et al. (2007) *Plant Cell,* 19:1750-1769; Fattash et al. (2007) *BMC Plant Biol.,* 7:13), poplar (Lu et al. (2005) *Plant Cell,* 17:2186-2203), green algae (Molnár et al. (2007) *Nature,* 447:1126-1130), and maize (Lauter et al. (2005) *Proc. Natl. Acad. Sci. USA,* 102:9412-9417). To this list were added 203 *Arabidopsis thaliana* loci from the publicly accessible *Arabidopsis* Small RNA Project (available on line at asrp.cgrb.oregonstate.edu/db/microRNAfamily.html). From this list, a gene function keyword "dictionary" from the available functional annotation was compiled, including known keyword variants (Table 1).

Any functional annotation of a given predicted miRNA target was searched for a match to the dictionary's keywords. A computational algorithm was developed to match the longest keyword first, second longest keyword second, and so on, to reduce false positives in keyword match. Where a match was found, the predicted target was deemed validated. This approach was applied to miRNA targets that had been predicted from proprietary sequence databases from various plant species; the computationally validated miRNA targets thus identified are given in Table 2.

Identification of validated miRNA targets allows the manipulation of the interaction between a given miRNA and its target gene (whether a native gene or a transgene that contains a validated miRNA recognition site). For example, over-expression of a target gene containing a validated miRNA target (validated miRNA recognition site) is expected to reduce the effect of that particular miRNA in the biochemical network or networks involving the miRNA.

Alternatively, an artificial transcript that includes the same miRNA target sequence (or one modified to prevent cleavage by an RNase II ribonuclease) can be used as a miRNA "decoy" (as described in co-assigned U.S. patent application Ser. No. 11/974,469, published as U.S. Patent Application Publication 2009-0070898 A1, which disclosure is specifically incorporated by reference herein), competing with the endogenous target gene to bind to that particular miRNA and thereby reducing the effect of the miRNA (e.g., suppression of the target gene and reduction of the effect of the miRNA on other genes downstream of the target gene) in the biochemical network or networks involving the miRNA. Knowledge of the validated miRNA targets disclosed herein allows one of ordinary skill in the art to use the miRNA target sequences as scaffolds for designing artificial sequences useful as transgenic miRNA decoys to reduce the effect of the miRNA on its target gene(s), or to identify endogenous sequences that are similarly useful as miRNA decoys. Thus, this application further provides and claims miRNA decoys for the validated miRNA targets disclosed herein, as well as miRNA decoys for all miRNA sequences that have been publicly disclosed, including, but not limited to, the miRNAs available at miRBase (microrna.sanger.ac.uk), and the mature miRNAs and miRNA precursors disclosed in U.S. patent application Ser. Nos. 11/303,745 (published as U.S. Patent Application Publication 2006/0200878), 11/974,469 (published as U.S. Patent Application Publication 2009-0070898 A1), 11/868, 081 (published as U.S. Patent Application Publication 2008/ 0115240), 10/884,374 (published as U.S. Patent Application Publication 2005/0144669), and 10/490,955 (now U.S. Pat. No. 7,232,806), which specifications are specifically incorporated by reference in their entirety herein.

In yet another embodiment, this invention further provides a miRNA-unresponsive transgene by modifying the sequence of a validated miRNA recognition site in the transgene to prevent binding and/or cleavage by that particular miRNA. In one example, increased expression of a gene that is normally modulated by an endogenous miRNA may be achieved by expressing a recombinant DNA construct encoding a miRNA-unresponsive transgene having a nucleotide sequence derived from the native nucleotide sequence of the gene but wherein a miRNA recognition site in the native nucleotide sequence is deleted or otherwise modified to prevent miRNA-mediated cleavage. In still another embodiment, this invention provides a transgene sequence that is modified by the addition of a validated miRNA recognition site in order to place that transgene under the control of that particular miRNA; in a variation on this, a transgenic plant is made by introducing into its genome both the transgene as well as an exogenous precursor of the particular miRNA that is to regulate the transgene.

TABLE 1 miRNA target keyword dictionary

| | |
|---|---|
| miR156 | Squamosa Promoter Binding Protein, Squamosa Promoter Binding, Squamosa Promoter-Binding, SBP-like, SPL, SPL2, SPL15, SPL9, SPL13, SPL4, SPL10, SPL6, SPL11, SBP domain containing protein, SBP domain, SBP-domain, teosinte glume architecture, tga1 |
| miR157 | Squamosa Promoter Binding Protein, Squamosa Promoter Binding, Squamosa Promoter-Binding, SBP-like, SPL, SPL2, SPL15, SPL9, SPL13, SPL4, SPL10, SPL6, SPL11, SBP domain containing protein, SBP domain, SBP-domain, teosinte glume architecture, tga1 |

TABLE 1-continued

| | miRNA target keyword dictionary |
|---|---|
| miR158 | Pentatricopeptide repeat, pentatricopeptide (PPR), PPR, PPR-repeat, pentatricopeptide |
| miR159 | MYB, AtMYB65, AtMYB101, AtMYB104, GAMyB, myb domain protein, myb domain, myb protein, DUO1, MYB120, MYB97, MYB65, MYB33, myb-like DNA-binding domain, myb-like, myb-like DNA-binding |
| miR160 | Auxin Response Factor, ARF, ARF10, ARF16, ARF17, B3 DNA binding domain containing protein, B3 domain, B3 DNA-binding domain, B3 Domain-Containing |
| miR161 | Pentatricopeptide repeat, pentatricopeptide (PPR), PPR, PPR-repeat, EMB2654, EMBRYO DEFECTIVE 2654, pentatricopeptide |
| miR162 | Dicer-like 1, Dicer-like1, Dicer like 1, DCL, DCL1, CAF, SUS1, SIN1, ASU1, EMB76, EMB60, Dicer |
| miR163 | S-adenosylmethionine-dependent methyltransferase, SAMT, S-adenosyl-L-methionine: carboxyl methyltransferase, methyltransferase |
| miR164 | Cup-shaped cotyledon, Cup shaped cotyledon, CUC, NAM, NAC, CUC2, CUC1, NAM-like, NAC1, No Apical Meristem, ATAF, ANAC079/ANAC080, ANAC100, ANAC092, NAC domain protein, NAC domain, NAC domain-containing protein, NAC domain-containing |
| miR165 | Phavoluta, Phabulosa, Revoluta, Corona, PHB, PFV, CNA, HD-ZIPIII, HD-ZIP, HD ZIP, REV, PHV, AtHB8, AtHB15, ICU4, ATHB-15, INCURVATA 4, IFL, IFL1, HD-ZIP class III HD-Zip protein, HD-ZIP class III, HD-Zip protein, class III HD-Zip protein, class III HD-Zip, homeodomain/leucine zipper, rolled leaf1 (rld1), rolled leaf 1 rolled leaf, rld1, HB1 gene, HB1, HD-ZIP III |
| miR166 | Phavoluta, Phabulosa, Revoluta, Corona, PHB, PFV, CNA, HD-ZIPIII, HD-ZIP, HD ZIP, REV, PHV, AtHB8, AtHB15, ICU4, ATHB-15, INCURVATA 4, IFL, IFL1, HD-ZIP class III HD-Zip protein, HD-ZIP class III, HD-Zip protein, class III HD-Zip protein, class III HD-Zip, homeodomain/leucine zipper, rolled leaf1 (rld1), rolled leaf 1 rolled leaf, rld1, HB1 gene, HB1, HD-ZIP III |
| miR167 | Auxin Response Factor, ARF, ARF6, ARF8 |
| miR168 | Argonaute, AGO, AGO1, PINHEAD, ZWILLE, ZLL, AGO2, AGO3, AGO4, AGO5, AGO6, AGO7, AGO8, AGO9, AGO10, PNH/ZLL |
| miR169 | nuclear transcription factor Y, HAP2, CCAAT, CCAAT-binding, NFYa, HAP2b, HAP2b-like, HAP2ab-like, HAP2c-like, HAP2c, HAP2a, HAP2a-like |
| miR170 | Scarecrow-like, Scarecrow, SCL, SCARECROW gene regulator, SCARECROW gene, Scarecrow/GRAS transcription factors, GRAS, Scarecrow/GRAS, nodulation signaling pathway 2 protein, nodulation signaling pathway 2, Nodulation-Signaling Pathway 2, NSP2, nodulation signaling pathway, nodulation-Signaling Pathway, NSP1 |
| miR171 | Scarecrow-like, Scarecrow, SCL, SCARECROW gene regulator, SCARECROW gene, Scarecrow/GRAS transcription factors, GRAS, Scarecrow/GRAS, nodulation signaling pathway 2 protein, nodulation signaling pathway 2, Nodulation-Signaling Pathway 2, NSP2, nodulation signaling pathway, nodulation-Signaling Pathway, NSP1 |
| miR172 | *Apetala*, AP2, TOE1, TOE2, TOE3, SMZ, SNZ, Target of EAT, TOE, Schnarchzapfen, SCHLAFMUTZE, Glossy15, Glossy-15, Glossy 15, AP2 domain containing protein, AP2 domain protein, AP2 domain, *Apetala* floral homeotic protein APETALA2, *Apetala* floral homeotic protein, *Apetala* protein, APETALA2 |
| miR173 | TAS |
| miR319 | Teosinte Branched, *Cycloidea*, PCF, TCP, TCP2, TCP3, TCP4, TCP10, TCP24, TCP family transcription factor, TCP family, TCP domain protein, TCP-domain protein, maternal effect embryo arrest, Cyclin, CyCA, CyCB, CyCC, CyCD, CyCH, CyCT, CyCU |
| miR390 | TAS3, TAS, Ser/Thr/Tyr protein kinase, Ser/Thr/Tyr |
| miR393 | Transport inhibitor response, TIR, TIR1, F-box, F box, F-box family protein, F box family protein, F-box family, F box family, IPS1, GRH1, GRR1-LIKE, ubiquitin-protein ligase, ubiquitin protein ligase, basic helix-loop-helix (bHLH) family protein, bHLH, basic helix-loop-helix, F-box domain containing protein, F-box domain protein, F-box domain |
| miR394 | F-box, F box, F-box family protein, F box family protein, F-box family, F box family, F-box domain containing protein, F-box domain protein, F-box domain |
| miR395 | APS, AST, ATP-sulfurylase, sulfate transporter, sulphate transporter, AST68, APS1, APS3, APS4, ATP sulfurylase, sulfate adenylyltransferase, Sulfate transporter |
| miR396 | Growth regulation factor, GRL, GRF, GROWTH-REGULATING FACTOR, GROWTH REGULATING FACTOR, AtGRF3, AtGRF4, AtGRF8, AtGRF7, AtGRF1 AtGRF2, AtGRF |
| miR397 | Laccase, LAC, PCL, plantacyanin, plastacyanin, blue copper binding protein, IRX12, copper ion binding |
| miR398 | Copper superoxide dismutase, superoxide dismutase 2, CSD, CSD2, COPPER/ZINC SUPEROXIDE DISMUTASE, COPPER ZINC SUPEROXIDE DISMUTASE, COPPER-ZINC SUPEROXIDE DISMUTASE, cytochrome c oxidase, cytochromec oxidase, cytochrome-c oxidase |
| miR399 | E2 ubiquitin conjugating enzyme, PHO2, ubiquitin-protein ligase, ubiquitin protein ligase, UBC24, ubiquitin conjugating enzyme, ubiquitin conjugating |
| miR400 | Pentatricopeptide repeat, pentatricopeptide (PPR), PPR, EMB2745, EMBRYO DEFECTIVE 2745, pentatricopeptide |
| miR402 | DML3, DEMETER-LIKE PROTEIN 3, DEMETER-LIKE PROTEIN, DEMETER LIKE PROTEIN |
| miR403 | AGO, Argonaute, AGO2 |
| miR408 | Laccase, LAC, LAC3, PCL, plantacyanin, plastacyanin, blue copper binding protein, blue copper binding, ARPN, copper ion binding, blue copper protein |
| miR444 | MADS box, MADS-box, MADS |
| miR447 | 2-phosphoglycerate kinase-related, 2-phosphoglycerate kinase, phosphoglycerate kinase |

TABLE 1-continued

| miRNA target keyword dictionary | |
|---|---|
| miR472 | RFL1, RPS5, RPS5-LIKE 1, ATP binding, RPS5, RESISTANT TO *P. SYRINGAE* 5, disease resistance protein (CC-NBS-LRR class), disease resistance protein, CC-NBS-LRR, NBS-LRR disease resistance protein, NBS-LRR type disease resistance protein |
| miR473 | GRAS domain-containing protein, AtGAI, AtLAS, AtPAT1, AtRGA, AtRGL1, AtRGL2, AtRGL3, AtSCL1, AtSCL11, AtSCL13, AtSCL14, AtSCL15, AtSCL16, AtSCL18, AtSCL21, AtSCL22, AtSCL23, AtSCL26, AtSCL27, AtSCL28, AtSCL29, AtSCL3, AtSCL30, AtSCL31, AtSCL32, AtSCL33, AtSCL4, AtSCL5, AtSCL6, AtSCL7, AtSCL8, AtSCL9, AtSCR, AtSHR, REPRESSOR, RGA2, RGA-LIKE 1, RGL, RGL1, SGR7, VHS4, VHS5 |
| miR474 | Pentatricopeptide repeat, pentatricopeptide (PPR), PPR, PPR-repeat, EMB2654, EMBRYO DEFECTIVE 2654, pentatricopeptide |
| miR475 | Pentatricopeptide repeat, pentatricopeptide (PPR), PPR, PPR-repeat, EMB2654, EMBRYO DEFECTIVE 2654, pentatricopeptide |
| miR476 | Pentatricopeptide repeat, pentatricopeptide (PPR), PPR, PPR-repeat, EMB2654, EMBRYO DEFECTIVE 2654, pentatricopeptide |
| miR477 | Basic helix-loop helix (bHLH) transcription factor, transcription factor/zinc ion binding CONSTANS-like, GRAS domain-containing protein, bHLH, GRAS, CONSTANS-like, CONSTANS |
| miR478 | Organic anion transporter-like protein, Organic anion transporter |
| miR480 | Proton-dependent oligopeptide transport family protein, Proton-dependent oligopeptide transport, Proton dependent oligopeptide transport |
| miR482 | Putative disease resistance protein, disease resistance protein, disease resistance |
| miR529 | Ethylene-response factor/AP2 domain transcription factor, erf/ap2, Ethylene-response factor/AP2 |
| miR534 | Ankyrin-repeat proteins, Ankyrin repeat proteins, Ankyrin-repeat protein, Ankyrin-repeat, Ankyrin repeat |
| miR536 | F-box, F box, F-box family protein, F box family protein, F-box family, F box family, F-box protein |
| miR538 | MADS-box, MADS |
| miR771 | eukaryotic translation initiation factor 2 family protein, eIF-2 family protein, eIF-2, eIF2 |
| miR773 | DMT02, DMT2, MET02, MET2, DNA methyltransferase 2, DNA (cytosine-5-)-methyltransferase |
| miR774 | F-box family, F-box, F box, F-box domain containing protein, F-box domain protein, F-box domain |
| miR775 | galactosyltransferase family protein, galactosyltransferase family, galactosyltransferase |
| miR776 | IRE, INCOMPLETE ROOT HAIR ELONGATION |
| miR777 | COP1-interacting protein-related, COP1-interacting protein, COP1-interacting, COP1 interacting |
| miR778 | SET-domain, SET, SUVH6, SUVH5, SU(VAR)3-9 homolog |
| miR779 | leucine-rich repeat transmembrane protein kinase, leucine-rich repeat, leucine rich repeat, transmembrane protein kinase, transmembrane |
| miR780 | CHX18, ATCHX18, cation/hydrogen exchanger 18, monovalent cation: proton antiporter, proton antiporter |
| miR781 | InterPro: IPR003169, SWIB complex BAF60b domain-containing protein, SWIB complex BAF60b domain, SWIB, BAF60b, plus-3 domain-containing protein, plus-3 domain, plus-3, GYF domain-containing protein, GYF domain |
| miR809 | Mlo disease resistant protein gene, Mlo-like, Mlo |
| miR818 | ENT domain protein gene, ENT domain, ENT-domain |
| miR820 | DNA cytosine methyltransferase, cytosine methyltransferase |
| miR823 | CMT3, CHROMOMETHYLASE 3, CHROMOMETHYLASE |
| miR824 | MADS-box, MADS, AGL16, AGAMOUS-LIKE, AGAMOUS |
| miR827 | SPX, NLA, SYG1/Pho81/XPR1, zinc finger, zinc-finger, C3HC4-type RING finger, C3HC4 |
| miR828 | MYB, myb domain protein, myb protein, AtMYB113, MYB113, MYB-like protein, myb-like, myb-like DNA-binding |
| miR842 | JR/MBP, jacalin lectin family protein, jacalin lectin family, jacalin lectin, jacalin, lectin |
| miR844 | protein kinase family protein, protein kinase family, protein kinase |
| miR846 | JR/MBP, InterPro: IPR001229, jasmonate inducible protein, jacalin lectin family protein, jacalin lectin family, jacalin lectin, jacalin, lectin |
| miR856 | Zinc transporter, Zinc-transporter, ACHX18, ATCHX18 | ATCHX18, cation/hydrogen exchanger 18, cation/hydrogen exchanger, monovalent cation: proton antiporter, proton antiporter, antiporter |
| miR857 | LAC, LAC7, laccase 7, copper ion binding, copper-ion binding |
| miR858 | MYB, myb domain protein, myb protein, MYB12, AtMYB12, AtMYB83, MYB83, MYB-like protein, myb-like, myb-like DNA-binding |
| miR859 | F-box, F box, F-box family protein, F box family protein, F-box family, F box family, F-box protein, InterPro: IPR006527, UDP-3-O-acyl N-acetylglycosamine deacetylase family protein, UDP-3-O-acyl N-acetylglycosamine deacetylase family, UDP-3-O-acyl N-acetylglycosamine deacetylase, UDP-3-O-acyl N-acetylglycosamine, F-box domain containing protein, F-box domain protein, F-box domain |
| miR902 | Basic helix-loop helix (bHLH) transcription factor, bHLH |
| miR904 | AGO, Argonaute |
| miR1029 | Ethylene-response factor/AP2 domain transcription factor, Ethylene-response factor, Ethylene response factor, erf/AP2 |
| miR1219c | Auxin Response Factors, Auxin Response Factor, arf |

TABLE 2

Computationally validated miRNA targets

| miRNA | Gene Function | SEQ ID NO: | Gene ID | Species of origin* |
|---|---|---|---|---|
| miR156/157 | SPL | 15 | PHE0014564 | *Arabidopsis thaliana* |
| miR156/157 | SPL | 16 | PHE0014996 | *A. thaliana* |
| miR156/157 | Squamosa Promoter Binding Protein | 17 | PHE0004508 | *A. thaliana* |
| miR156/157 | Squamosa Promoter Binding Protein | 18 | PHE0004925 | *A. thaliana* |
| miR160 | ARF | 19 | PHE0003525 | *A. thaliana* |
| miR164 | ANAC092 | 20 | PHE0013733 | *A. thaliana* |
| miR164 | NAC domain protein | 21 | PHE0001074 | *A. thaliana* |
| miR165/166 | Revoluta | 22 | PHE0008129 | *A. thaliana* |
| miR165/166 | Revoluta | 23 | PHE0010493 | *A. thaliana* |
| miR165/166 | Revoluta | 24 | PHE0012654 | *A. thaliana* |
| miR165/166 | Revoluta | 25 | PHE0007271 | *A. thaliana* |
| miR165/166 | Revoluta | 26 | PHE0007467 | *A. thaliana* |
| miR165/166 | Revoluta | 27 | PHE0007720 | *A. thaliana* |
| miR165/166 | Revoluta | 28 | PHE0010355 | *A. thaliana* |
| miR165/166 | Revoluta | 29 | PHE0010473 | *A. thaliana* |
| miR165/166 | Revoluta | 30 | PHE0010494 | *A. thaliana* |
| miR165/166 | Revoluta | 31 | PHE0010495 | *A. thaliana* |
| miR165/166 | Revoluta | 32 | PHE0010537 | *A. thaliana* |
| miR166 | Revoluta | 33 | PHE0010496 | *A. thaliana* |
| miR166 | Revoluta | 34 | PHE0010497 | *A. thaliana* |
| miR166 | Revoluta | 35 | PHE0010500 | *A. thaliana* |
| miR167 | ARF | 36 | PHE0003428 | *A. thaliana* |
| miR172 | AP2 | 37 | PHE0003881 | *A. thaliana* |
| miR172 | AP2 domain | 38 | PHE0006606 | *A. thaliana* |
| miR393 | F-box | 39 | PHE0007151 | *A. thaliana* |
| miR393 | F-box | 40 | PHE0007164 | *A. thaliana* |
| miR393 | F-box | 41 | PHE0007167 | *A. thaliana* |
| miR393 | Transport inhibitor response | 42 | PHE0004988 | *A. thaliana* |
| miR396 | GRL | 43 | PHE0004617 | *A. thaliana* |
| miR778 | SET-domain | 44 | PHE0006443 | *A. thaliana* |
| miR779 | leucine-rich repeat transmembrane protein kinase | 45 | PHE0002993 | *A. thaliana* |
| miR858 | MYB | 46 | PHE0001073 | *A. thaliana* |
| miR858 | MYB | 47 | PHE0001093 | *A. thaliana* |
| miR858 | MYB | 48 | PHE0002073 | *A. thaliana* |
| miR858 | MYB | 49 | PHE0010073 | *A. thaliana* |
| miR858 | MyB | 50 | PHE0011722 | *A. thaliana* |
| miR858 | MyB | 51 | PHE0015935 | *A. thaliana* |
| miR859 | F-box | 52 | PHE0003311 | *A. thaliana* |
| miR859 | F-box | 53 | PHE0006468 | *A. thaliana* |
| miR902 | bHLH | 54 | PHE0000658 | *A. thaliana* |
| miR902 | bHLH | 55 | PHE0006524 | *A. thaliana* |
| miR156 | Squamosa Promoter Binding Protein | 56 | MRT3708_37334C.1 | Canola (*Brassica napus* or *Brassica rapa*) |
| miR156/157 | Squamosa Promoter Binding Protein | 57 | MRT3708_10628C.4 | Canola |
| miR156/157 | Squamosa Promoter Binding Protein | 58 | MRT3708_22559C.1 | Canola |
| miR156/157 | Squamosa Promoter Binding Protein | 59 | MRT3708_30289C.3 | Canola |
| miR156/157 | Squamosa Promoter Binding Protein | 60 | MRT3708_39670C.2 | Canola |
| miR156/157 | Squamosa Promoter Binding Protein | 61 | MRT3708_53675C.1 | Canola |
| miR156/157 | Squamosa Promoter Binding Protein | 62 | MRT3708_58630C.1 | Canola |
| miR159 | MYB | 63 | MRT3708_33278C.1 | Canola |
| miR159 | MYB | 64 | MRT3708_33279C.1 | Canola |
| miR163 | methyltransferase | 65 | MRT3708_16440C.1 | Canola |
| miR163 | methyltransferase | 66 | MRT3708_28174C.1 | Canola |
| miR163 | methyltransferase | 67 | MRT3708_52155C.2 | Canola |
| miR164 | NAM | 68 | MRT3708_39966C.1 | Canola |
| miR164 | No Apical Meristem | 69 | MRT3708_51022C.1 | Canola |
| miR164 | No Apical Meristem | 70 | MRT3708_7877C.4 | Canola |
| miR165/166 | class III HD-Zip protein | 71 | MRT3708_45624C.1 | Canola |
| miR165/166 | HD-Zip protein | 72 | MRT3708_5493C.1 | Canola |
| miR167 | Auxin Response Factor | 73 | MRT3708_37499C.2 | Canola |
| miR167 | Auxin Response Factor | 74 | MRT3708_50323C.1 | Canola |
| miR169 | CCAAT-binding | 75 | MRT3708_45516C.2 | Canola |
| miR169 | CCAAT-binding | 76 | MRT3708_46224C.1 | Canola |
| miR169 | CCAAT-binding | 77 | MRT3708_56325C.1 | Canola |
| miR169 | nuclear transcription factor Y | 78 | MRT3708_42756C.1 | Canola |
| miR170/171 | SCARECROW gene regulator | 79 | MRT3708_34048C.2 | Canola |
| miR172 | AP2 | 80 | MRT3708_39387C.1 | Canola |
| miR172 | AP2 domain | 81 | MRT3708_36942C.2 | Canola |
| miR393 | Transport inhibitor response | 82 | MRT3708_31301C.1 | Canola |
| miR393 | Transport inhibitor response | 83 | MRT3708_52518C.1 | Canola |
| miR393 | Transport inhibitor response | 84 | MRT3708_55951C.1 | Canola |
| miR394 | F-box | 85 | MRT3708_61891C.1 | Canola |

TABLE 2-continued

Computationally validated miRNA targets

| miRNA | Gene Function | SEQ ID NO: | Gene ID | Species of origin* |
|---|---|---|---|---|
| miR395 | ATP sulfurylase | 86 | MRT3708_35187C.3 | Canola |
| miR395 | sulfate adenylyltransferase | 87 | MRT3708_36129C.1 | Canola |
| miR395 | sulfate adenylyltransferase | 88 | MRT3708_55043C.1 | Canola |
| miR396 | Growth-regulating factor | 89 | MRT3708_29578C.1 | Canola |
| miR396 | Growth-regulating factor | 90 | MRT3708_51563C.1 | Canola |
| miR398 | cytochrome c oxidase | 91 | MRT3708_47361C.2 | Canola |
| miR400 | PPR | 92 | MRT3708_57455C.1 | Canola |
| miR408 | blue copper protein | 93 | MRT3708_29149C.3 | Canola |
| miR472 | ATP binding | 94 | MRT3708_45273C.1 | Canola |
| miR472 | ATP binding | 95 | MRT3708_55890C.1 | Canola |
| miR472 | ATP binding | 96 | MRT3708_55902C.2 | Canola |
| miR824 | MADS-box | 97 | MRT3708_59018C.1 | Canola |
| miR827 | zinc finger | 98 | MRT3708_29390C.1 | Canola |
| miR828 | myb-like DNA-binding | 99 | MRT3708_31708C.1 | Canola |
| miR856 | antiporter | 100 | MRT3708_61144C.1 | Canola |
| miR857 | LAC | 101 | MRT3708_24461C.1 | Canola |
| miR858 | MYB | 102 | MRT3708_31372C.1 | Canola |
| miR858 | myb-like DNA-binding | 103 | MRT3708_16589C.4 | Canola |
| miR858 | myb-like DNA-binding | 104 | MRT3708_29291C.3 | Canola |
| miR858 | myb-like DNA-binding | 105 | MRT3708_54665C.1 | Canola |
| miR858 | myb-like DNA-binding | 106 | MRT3708_61897C.1 | Canola |
| miR859 | F-box domain | 107 | MRT3708_51653C.1 | Canola |
| miR167 | Auxin Response Factor | 108 | MRT3711_1592C.1 | Field mustard (*Brassica rapa* or *Brassica campestris*) |
| miR168 | Argonaute | 109 | MRT3711_4500C.2 | Field mustard |
| miR169 | nuclear transcription factor Y | 110 | MRT3711_4547C.1 | Field mustard |
| miR172 | AP2 | 111 | MRT3711_6838C.1 | Field mustard |
| miR319 | PCF | 112 | MRT3711_7220C.1 | Field mustard |
| miR393 | Transport inhibitor response | 113 | MRT3711_1771C.1 | Field mustard |
| miR395 | sulfate adenylyltransferase | 114 | MRT3711_3394C.1 | Field mustard |
| miR395 | sulfate adenylyltransferase | 115 | MRT3711_4165C.1 | Field mustard |
| miR395 | sulfate adenylyltransferase | 116 | MRT3711_4313C.1 | Field mustard |
| miR472 | ATP binding | 117 | MRT3711_7972C.1 | Field mustard |
| miR827 | zinc finger | 118 | MRT3711_10064C.1 | Field mustard |
| miR858 | myb-like DNA-binding | 119 | MRT3711_7980C.1 | Field mustard |
| miR156/157 | SBP domain | 120 | MRT3847_197471C.3 | *Glycine max* |
| miR156/157 | SBP domain | 121 | MRT3847_202791C.3 | *G. max* |
| miR156/157 | SBP domain | 122 | MRT3847_28990C.5 | *G. max* |
| miR156/157 | SBP domain | 123 | MRT3847_39715C.7 | *G. max* |
| miR156/157 | Squamosa Promoter Binding Protein | 124 | MRT3847_207934C.2 | *G. max* |
| miR156/157 | Squamosa Promoter Binding Protein | 125 | MRT3847_257545C.4 | *G. max* |
| miR156/157 | Squamosa Promoter Binding Protein | 126 | MRT3847_217782C.3 | *G. max* |
| miR156/157 | Squamosa Promoter Binding Protein | 127 | MRT3847_235081C.4 | *G. max* |
| miR156/157 | Squamosa Promoter Binding Protein | 128 | MRT3847_235082C.6 | *G. max* |
| miR156/157 | Squamosa Promoter Binding Protein | 129 | MRT3847_289291C.3 | *G. max* |
| miR156/157 | Squamosa Promoter Binding Protein | 130 | MRT3847_335568C.1 | *G. max* |
| miR156/157 | Squamosa Promoter Binding Protein | 131 | MRT3847_350831C.1 | *G. max* |
| miR156/157 | Squamosa Promoter Binding Protein | 132 | MRT3847_14683C.5 | *G. max* |
| miR156/157 | Squamosa Promoter Binding Protein | 133 | MRT3847_237444C.4 | *G. max* |
| miR156/157 | Squamosa Promoter Binding Protein | 134 | MRT3847_329752C.1 | *G. max* |
| miR156/157 | Squamosa Promoter Binding Protein | 135 | MRT3847_334134C.1 | *G. max* |
| miR156/157 | teosinte glume architecture | 136 | MRT3847_338602C.1 | *G. max* |
| miR159 | myb-like DNA-binding domain | 137 | MRT3847_345009C.1 | *G. max* |
| miR159 | myb-like DNA-binding domain | 138 | MRT3847_346338C.1 | *G. max* |
| miR160 | ARF | 139 | PHE0003526 | *G. max* |
| miR160 | Auxin Response Factor | 140 | MRT3847_139013C.5 | *G. max* |
| miR160 | Auxin Response Factor | 141 | MRT3847_197785C.3 | *G. max* |
| miR160 | Auxin Response Factor | 142 | MRT3847_239685C.2 | *G. max* |
| miR160 | Auxin Response Factor | 143 | MRT3847_269589C.4 | *G. max* |
| miR160 | Auxin Response Factor | 144 | MRT3847_28328C.3 | *G. max* |
| miR160 | Auxin Response Factor | 145 | MRT3847_289982C.2 | *G. max* |
| miR160 | Auxin Response Factor | 146 | MRT3847_37862C.4 | *G. max* |
| miR160 | Auxin Response Factor | 147 | MRT3847_41982C.5 | *G. max* |
| miR160 | Auxin Response Factor | 148 | MRT3847_52071C.7 | *G. max* |
| miR161 | pentatricopeptide | 149 | MRT3847_4014C.4 | *G. max* |
| miR161 | PPR | 150 | MRT3847_20482C.2 | *G. max* |
| miR161 | PPR | 151 | MRT3847_227121C.4 | *G. max* |
| miR164 | NAC domain protein | 152 | MRT3847_46332C.2 | *G. max* |
| miR164 | NAC domain protein | 153 | MRT3847_46333C.6 | *G. max* |
| miR164 | NAC1 | 154 | PHE0001363 | *G. max* |
| miR164 | NAM | 155 | MRT3847_244824C.2 | *G. max* |
| miR164 | No Apical Meristem | 156 | MRT3847_259513C.2 | *G. max* |
| miR164 | No Apical Meristem | 157 | MRT3847_270117C.3 | *G. max* |

TABLE 2-continued

Computationally validated miRNA targets

| miRNA | Gene Function | SEQ ID NO: | Gene ID | Species of origin* |
|---|---|---|---|---|
| miR164 | No Apical Meristem | 158 | MRT3847_48464C.4 | G. max |
| miR164 | No Apical Meristem | 159 | MRT3847_48465C.6 | G. max |
| miR165/166 | class III HD-Zip protein | 160 | MRT3847_209034C.4 | G. max |
| miR165/166 | class III HD-Zip protein | 161 | MRT3847_233286C.5 | G. max |
| miR165/166 | class III HD-Zip protein | 162 | MRT3847_248020C.5 | G. max |
| miR165/166 | class III HD-Zip protein | 163 | MRT3847_288367C.4 | G. max |
| miR165/166 | class III HD-Zip protein | 164 | MRT3847_296736C.1 | G. max |
| miR165/166 | class III HD-Zip protein | 165 | MRT3847_326691C.1 | G. max |
| miR165/166 | class III HD-Zip protein | 166 | MRT3847_345104C.1 | G. max |
| miR165/166 | class III HD-Zip protein | 167 | MRT3847_348410C.1 | G. max |
| miR166 | Homeobox | 168 | PHE0003454 | G. max |
| miR167 | ARF | 169 | PHE0003655 | G. max |
| miR167 | Auxin Response Factor | 170 | MRT3847_195447C.5 | G. max |
| miR167 | Auxin Response Factor | 171 | MRT3847_263906C.5 | G. max |
| miR167 | Auxin Response Factor | 172 | MRT3847_305421C.4 | G. max |
| miR167 | Auxin Response Factor | 173 | MRT3847_340154C.1 | G. max |
| miR167 | Auxin Response Factor | 174 | MRT3847_41926C.6 | G. max |
| miR167 | Auxin Response Factor | 175 | MRT3847_55334C.5 | G. max |
| miR169 | CCAAT-binding | 176 | MRT3847_251095C.3 | G. max |
| miR169 | CCAAT-binding | 177 | MRT3847_259875C.4 | G. max |
| miR169 | CCAAT-binding | 178 | MRT3847_293871C.3 | G. max |
| miR169 | CCAAT-binding | 179 | MRT3847_305217C.3 | G. max |
| miR169 | CCAAT-binding | 180 | MRT3847_347487C.1 | G. max |
| miR169 | CCAAT-binding | 181 | MRT3847_40604C.6 | G. max |
| miR169 | CCAAT-binding | 182 | MRT3847_53466C.6 | G. max |
| miR169 | CCAAT-binding | 183 | MRT3847_53467C.5 | G. max |
| miR169 | CCAAT-binding | 184 | MRT3847_54675C.6 | G. max |
| miR169 | NFYa | 185 | PHE0011547 | G. max |
| miR169 | nuclear transcription factor Y | 186 | MRT3847_25786C.5 | G. max |
| miR169 | nuclear transcription factor Y | 187 | MRT3847_289667C.3 | G. max |
| miR169 | nuclear transcription factor Y | 188 | MRT3847_312701C.1 | G. max |
| miR169 | nuclear transcription factor Y | 189 | MRT3847_335193C.1 | G. max |
| miR169 | nuclear transcription factor Y | 190 | MRT3847_51286C.6 | G. max |
| miR169 | nuclear transcription factor Y | 191 | MRT3847_54010C.4 | G. max |
| miR170/171 | Scarecrow-like | 192 | MRT3847_41579C.4 | G. max |
| miR171 | GRAS | 193 | MRT3847_267119C.3 | G. max |
| miR171 | GRAS | 194 | MRT3847_270988C.3 | G. max |
| miR171 | GRAS | 195 | MRT3847_275596C.2 | G. max |
| miR171 | GRAS | 196 | MRT3847_294457C.2 | G. max |
| miR171 | GRAS | 197 | MRT3847_344862C.1 | G. max |
| miR172 | AP2 domain | 198 | PHE0000638 | G. max |
| miR172 | AP2 domain | 199 | MRT3847_202930C.3 | G. max |
| miR172 | AP2 domain | 200 | MRT3847_21933C.5 | G. max |
| miR172 | AP2 domain | 201 | MRT3847_235857C.3 | G. max |
| miR172 | AP2 domain | 202 | MRT3847_257655C.4 | G. max |
| miR172 | AP2 domain | 203 | MRT3847_289890C.3 | G. max |
| miR172 | AP2 domain | 204 | MRT3847_289891C.3 | G. max |
| miR172 | AP2 domain | 205 | MRT3847_295726C.1 | G. max |
| miR172 | AP2 domain | 206 | MRT3847_326790C.1 | G. max |
| miR172 | AP2 domain | 207 | MRT3847_329301C.1 | G. max |
| miR172 | AP2 domain | 208 | MRT3847_43925C.7 | G. max |
| miR172 | AP2 domain | 209 | MRT3847_46007C.5 | G. max |
| miR172 | AP2 domain | 210 | MRT3847_51633C.3 | G. max |
| miR172 | AP2 domain | 211 | MRT3847_59804C.6 | G. max |
| miR172 | APETALA2 | 212 | MRT3847_196945C.3 | G. max |
| miR319 | Cyclin | 213 | MRT3847_238163C.3 | G. max |
| miR319 | PCF | 214 | MRT3847_262919C.1 | G. max |
| miR319 | TCP family transcription factor | 215 | MRT3847_230131C.1 | G. max |
| miR319 | TCP family transcription factor | 216 | MRT3847_304168C.2 | G. max |
| miR319 | TCP family transcription factor | 217 | MRT3847_336868C.1 | G. max |
| miR319 | TCP family transcription factor | 218 | MRT3847_343365C.1 | G. max |
| miR319 | TCP family transcription factor | 219 | MRT3847_38312C.5 | G. max |
| miR319 | TCP family transcription factor | 220 | MRT3847_103008C.6 | G. max |
| miR319 | TCP family transcription factor | 221 | MRT3847_12165C.5 | G. max |
| miR319 | TCP family transcription factor | 222 | MRT3847_247420C.4 | G. max |
| miR319 | TCP family transcription factor | 223 | MRT3847_294519C.4 | G. max |
| miR319 | TCP family transcription factor | 224 | MRT3847_334277C.1 | G. max |
| miR390 | TAS | 225 | MRT3847_133706C.5 | G. max |
| miR390 | TAS | 226 | MRT3847_298568C.2 | G. max |
| miR390 | TAS | 227 | MRT3847_60306C.8 | G. max |
| miR393 | TIR1 | 228 | MRT3847_238705C.4 | G. max |
| miR393 | TIR1 | 229 | MRT3847_27973C.7 | G. max |
| miR393 | TIR1 | 230 | MRT3847_313402C.3 | G. max |
| miR393 | Transport inhibitor response | 231 | MRT3847_329954C.2 | G. max |
| miR393 | Transport inhibitor response | 232 | MRT3847_335477C.1 | G. max |

TABLE 2-continued

Computationally validated miRNA targets

| miRNA | Gene Function | SEQ ID NO: | Gene ID | Species of origin* |
|---|---|---|---|---|
| miR393 | Transport inhibitor response | 233 | MRT3847_44371C.6 | G. max |
| miR394 | F-box domain | 234 | MRT3847_249313C.3 | G. max |
| miR394 | F-box domain | 235 | MRT3847_260044C.4 | G. max |
| miR395 | AST | 236 | MRT3847_118061C.7 | G. max |
| miR395 | AST | 237 | MRT3847_120571C.4 | G. max |
| miR395 | AST | 238 | MRT3847_161863C.4 | G. max |
| miR395 | AST | 239 | MRT3847_233832C.4 | G. max |
| miR395 | AST | 240 | MRT3847_294717C.3 | G. max |
| miR395 | AST | 241 | MRT3847_303988C.3 | G. max |
| miR395 | AST | 242 | MRT3847_336528C.1 | G. max |
| miR395 | AST | 243 | MRT3847_55707C.5 | G. max |
| miR395 | ATP sulfurylase | 244 | MRT3847_14792C.7 | G. max |
| miR395 | sulfate adenylyltransferase | 245 | MRT3847_331787C.1 | G. max |
| miR395 | sulfate transporter | 246 | MRT3847_10451C.5 | G. max |
| miR395 | sulfate transporter | 247 | MRT3847_245035C.3 | G. max |
| miR396 | GRF | 248 | PHE0001215 | G. max |
| miR396 | Growth-regulating factor | 249 | MRT3847_183050C.6 | G. max |
| miR396 | Growth-regulating factor | 250 | MRT3847_200704C.5 | G. max |
| miR396 | Growth-regulating factor | 251 | MRT3847_21877C.7 | G. max |
| miR396 | Growth-regulating factor | 252 | MRT3847_275465C.2 | G. max |
| miR396 | Growth-regulating factor | 253 | MRT3847_285089C.5 | G. max |
| miR396 | Growth-regulating factor | 254 | MRT3847_307974C.3 | G. max |
| miR396 | Growth-regulating factor | 255 | MRT3847_34351C.6 | G. max |
| miR396 | Growth-regulating factor | 256 | MRT3847_39577C.5 | G. max |
| miR397 | Laccase | 257 | MRT3847_148737C.1 | G. max |
| miR397 | Laccase | 258 | MRT3847_196074C.1 | G. max |
| miR397 | Laccase | 259 | MRT3847_240006C.2 | G. max |
| miR397 | Laccase | 260 | MRT3847_256982C.1 | G. max |
| miR397 | Laccase | 261 | MRT3847_25859C.5 | G. max |
| miR397 | Laccase | 262 | MRT3847_29767C.4 | G. max |
| miR397 | Laccase | 263 | MRT3847_297900C.1 | G. max |
| miR397 | Laccase | 264 | MRT3847_309594C.2 | G. max |
| miR397 | Laccase | 265 | MRT3847_33656C.5 | G. max |
| miR397 | Laccase | 266 | MRT3847_347553C.1 | G. max |
| miR397 | Laccase | 267 | MRT3847_36695C.5 | G. max |
| miR397 | Laccase | 268 | MRT3847_49069C.6 | G. max |
| miR397 | Laccase | 269 | MRT3847_7864C.1 | G. max |
| miR397 | Laccase | 270 | MRT3847_99867C.5 | G. max |
| miR398 | COPPER/ZINC SUPEROXIDE DISMUTASE | 271 | MRT3847_235546C.3 | G. max |
| miR400 | pentatricopeptide | 272 | MRT3847_12750C.4 | G. max |
| miR400 | pentatricopeptide | 273 | MRT3847_17367C.3 | G. max |
| miR400 | PPR | 274 | MRT3847_10096C.3 | G. max |
| miR400 | PPR | 275 | MRT3847_139832C.5 | G. max |
| miR400 | PPR | 276 | MRT3847_141759C.5 | G. max |
| miR400 | PPR | 277 | MRT3847_218904C.2 | G. max |
| miR400 | PPR | 278 | MRT3847_267668C.2 | G. max |
| miR400 | PPR | 279 | MRT3847_57083C.4 | G. max |
| miR408 | blue copper protein | 280 | PHE0000330 | G. max |
| miR408 | blue copper protein | 281 | MRT3847_273288C.3 | G. max |
| miR408 | blue copper protein | 282 | MRT3847_329905C.2 | G. max |
| miR408 | blue copper protein | 283 | MRT3847_336704C.1 | G. max |
| miR408 | blue copper protein | 284 | MRT3847_343250C.1 | G. max |
| miR408 | blue copper protein | 285 | MRT3847_346770C.1 | G. max |
| miR408 | blue copper protein | 286 | MRT3847_349900C.1 | G. max |
| miR408 | blue copper protein | 287 | MRT3847_350132C.1 | G. max |
| miR408 | blue copper protein | 288 | MRT3847_60064C.6 | G. max |
| miR408 | blue copper protein | 289 | MRT3847_66506C.8 | G. max |
| miR408 | Laccase | 290 | MRT3847_296270C.2 | G. max |
| miR408 | Laccase | 291 | MRT3847_31127C.7 | G. max |
| miR444 | MADS box | 292 | PHE0002647 | G. max |
| miR444 | MADS box | 293 | PHE0002648 | G. max |
| miR444 | MADS box | 294 | PHE0015540 | G. max |
| miR444 | MADS-box | 295 | MRT3847_247970C.2 | G. max |
| miR444 | MADS-box | 296 | MRT3847_259952C.3 | G. max |
| miR472 | ATP binding | 297 | MRT3847_324977C.1 | G. max |
| miR472 | ATP binding | 298 | MRT3847_335756C.1 | G. max |
| miR472 | disease resistance protein | 299 | MRT3847_348618C.1 | G. max |
| miR472 | NBS-LRR type disease resistance protein | 300 | MRT3847_292513C.3 | G. max |
| miR472 | NBS-LRR type disease resistance protein | 301 | MRT3847_34971C.6 | G. max |
| miR472/482 | disease resistance protein | 302 | MRT3847_159134C.1 | G. max |
| miR472/482 | disease resistance protein | 303 | MRT3847_208382C.4 | G. max |
| miR472/482 | disease resistance protein | 304 | MRT3847_229943C.2 | G. max |

TABLE 2-continued

Computationally validated miRNA targets

| miRNA | Gene Function | SEQ ID NO: | Gene ID | Species of origin* |
|---|---|---|---|---|
| miR472/482 | disease resistance protein | 305 | MRT3847_262606C.4 | G. max |
| miR472/482 | NBS-LRR type disease resistance protein | 306 | MRT3847_223192C.5 | G. max |
| miR472/482 | NBS-LRR type disease resistance protein | 307 | MRT3847_264890C.3 | G. max |
| miR475 | Pentatricopeptide repeat | 308 | MRT3847_204627C.1 | G. max |
| miR475 | Pentatricopeptide repeat | 309 | MRT3847_234253C.2 | G. max |
| miR475 | Pentatricopeptide repeat | 310 | MRT3847_289449C.2 | G. max |
| miR475 | Pentatricopeptide repeat | 311 | MRT3847_342062C.1 | G. max |
| miR475 | PPR | 312 | MRT3847_137370C.4 | G. max |
| miR475 | PPR | 313 | MRT3847_196480C.3 | G. max |
| miR475 | PPR | 314 | MRT3847_241148C.2 | G. max |
| miR475 | PPR | 315 | MRT3847_30662C.4 | G. max |
| miR475 | PPR | 316 | MRT3847_44502C.5 | G. max |
| miR475 | PPR-repeat | 317 | MRT3847_235882C.3 | G. max |
| miR477 | bHLH | 318 | MRT3847_117808C.5 | G. max |
| miR477 | bHLH | 319 | MRT3847_330789C.2 | G. max |
| miR477 | GRAS | 320 | MRT3847_161254C.2 | G. max |
| miR477 | GRAS | 321 | MRT3847_250541C.3 | G. max |
| miR482 | disease resistance protein | 322 | MRT3847_216742C.1 | G. max |
| miR482 | disease resistance protein | 323 | MRT3847_221164C.1 | G. max |
| miR482 | disease resistance protein | 324 | MRT3847_28447C.6 | G. max |
| miR482 | disease resistance protein | 325 | MRT3847_302802C.3 | G. max |
| miR482 | disease resistance protein | 326 | MRT3847_146432C.5 | G. max |
| miR482 | disease resistance protein | 327 | MRT3847_184524C.6 | G. max |
| miR482 | disease resistance protein | 328 | MRT3847_268743C.4 | G. max |
| miR482 | disease resistance protein | 329 | MRT3847_272693C.2 | G. max |
| miR482 | disease resistance protein | 330 | MRT3847_297146C.2 | G. max |
| miR482 | disease resistance protein | 331 | MRT3847_314629C.2 | G. max |
| miR482 | disease resistance protein | 332 | MRT3847_335514C.1 | G. max |
| miR482 | disease resistance protein | 333 | MRT3847_335735C.1 | G. max |
| miR482 | disease resistance protein | 334 | MRT3847_337518C.1 | G. max |
| miR482 | disease resistance protein | 335 | MRT3847_340947C.1 | G. max |
| miR482 | disease resistance protein | 336 | MRT3847_352235C.1 | G. max |
| miR482 | disease resistance protein | 337 | MRT3847_63055C.5 | G. max |
| miR482 | disease resistance protein | 338 | MRT3847_66636C.5 | G. max |
| miR482 | Putative disease resistance protein | 339 | MRT3847_184595C.4 | G. max |
| miR824 | MADS box | 340 | PHE0001395 | G. max |
| miR824 | MADS box | 341 | PHE0003427 | G. max |
| miR824 | MADS box | 342 | PHE0013854 | G. max |
| miR824 | MADS-box | 343 | MRT3847_14550C.4 | G. max |
| miR824 | MADS-box | 344 | MRT3847_39202C.7 | G. max |
| miR828 | MyB | 345 | PHE0001477 | G. max |
| miR828 | MYB | 346 | MRT3847_346366C.1 | G. max |
| miR828 | myb-like DNA-binding | 347 | MRT3847_215219C.3 | G. max |
| miR828 | myb-like DNA-binding | 348 | MRT3847_215220C.2 | G. max |
| miR828/858 | myb-like DNA-binding | 349 | MRT3847_22767C.2 | G. max |
| miR857 | LAC | 350 | MRT3847_13225C.3 | G. max |
| miR858 | MyB | 351 | PHE0000380 | G. max |
| miR858 | MYB | 352 | PHE0001408 | G. max |
| miR858 | MyB | 353 | PHE0004448 | G. max |
| miR858 | MyB | 354 | PHE0012029 | G. max |
| miR858 | MyB | 355 | PHE0015929 | G. max |
| miR858 | MYB | 356 | MRT3847_212141C.3 | G. max |
| miR858 | MYB | 357 | MRT3847_347736C.1 | G. max |
| miR858 | MYB | 358 | MRT3847_38379C.5 | G. max |
| miR858 | MYB | 359 | MRT3847_40737C.7 | G. max |
| miR858 | MYB | 360 | MRT3847_41334C.3 | G. max |
| miR858 | MYB12 | 361 | MRT3847_51246C.6 | G. max |
| miR858 | myb-like DNA-binding | 362 | MRT3847_131164C.6 | G. max |
| miR858 | myb-like DNA-binding | 363 | MRT3847_137726C.5 | G. max |
| miR858 | myb-like DNA-binding | 364 | MRT3847_228792C.3 | G. max |
| miR858 | myb-like DNA-binding | 365 | MRT3847_255360C.1 | G. max |
| miR858 | myb-like DNA-binding | 366 | MRT3847_255362C.6 | G. max |
| miR858 | myb-like DNA-binding | 367 | MRT3847_260391C.1 | G. max |
| miR858 | myb-like DNA-binding | 368 | MRT3847_261508C.2 | G. max |
| miR858 | myb-like DNA-binding | 369 | MRT3847_270136C.3 | G. max |
| miR858 | myb-like DNA-binding | 370 | MRT3847_290332C.2 | G. max |
| miR858 | myb-like DNA-binding | 371 | MRT3847_294239C.3 | G. max |
| miR858 | myb-like DNA-binding | 372 | MRT3847_322770C.2 | G. max |
| miR858 | myb-like DNA-binding | 373 | MRT3847_32417C.5 | G. max |
| miR858 | myb-like DNA-binding | 374 | MRT3847_332192C.1 | G. max |
| miR858 | myb-like DNA-binding | 375 | MRT3847_335664C.1 | G. max |
| miR858 | myb-like DNA-binding | 376 | MRT3847_34082C.5 | G. max |
| miR858 | myb-like DNA-binding | 377 | MRT3847_39825C.5 | G. max |

TABLE 2-continued

Computationally validated miRNA targets

| miRNA | Gene Function | SEQ ID NO: | Gene ID | Species of origin* |
|---|---|---|---|---|
| miR858 | myb-like DNA-binding | 378 | MRT3847_40203C.4 | G. max |
| miR858 | myb-like DNA-binding | 379 | MRT3847_41332C.5 | G. max |
| miR858 | myb-like DNA-binding | 380 | MRT3847_42168C.6 | G. max |
| miR858 | myb-like DNA-binding | 381 | MRT3847_51247C.3 | G. max |
| miR858 | myb-like DNA-binding | 382 | MRT3847_52127C.4 | G. max |
| miR858 | myb-like DNA-binding | 383 | MRT3847_54395C.5 | G. max |
| miR858 | myb-like DNA-binding | 384 | MRT3847_55676C.6 | G. max |
| miR156 | SBP domain | 385 | MRT3635_30868C.2 | Gossypium hirsutum |
| miR156/157 | SBP domain | 386 | MRT3635_36657C.2 | G. hirsutum |
| miR156/157 | SBP domain | 387 | MRT3635_65765C.1 | G. hirsutum |
| miR156/157 | Squamosa Promoter Binding Protein | 388 | MRT3635_15791C.2 | G. hirsutum |
| miR156/157 | Squamosa Promoter Binding Protein | 389 | MRT3635_48230C.2 | G. hirsutum |
| miR156/157 | Squamosa Promoter Binding Protein | 390 | MRT3635_69088C.1 | G. hirsutum |
| miR156/157 | Squamosa Promoter Binding Protein | 391 | MRT3635_69159C.1 | G. hirsutum |
| miR156/157 | Squamosa Promoter Binding Protein | 392 | MRT3635_30369C.2 | G. hirsutum |
| miR156/157 | Squamosa Promoter Binding Protein | 393 | MRT3635_56290C.1 | G. hirsutum |
| miR156/157 | teosinte glume architecture | 394 | MRT3635_15393C.1 | G. hirsutum |
| miR159 | MYB65 | 395 | MRT3635_249C.2 | G. hirsutum |
| miR159 | myb-like DNA-binding | 396 | MRT3635_54684C.2 | G. hirsutum |
| miR160 | Auxin Response Factor | 397 | MRT3635_36222C.2 | G. hirsutum |
| miR162 | CAF | 398 | MRT3635_16630C.2 | G. hirsutum |
| miR164 | NAC domain protein | 399 | MRT3635_24172C.2 | G. hirsutum |
| miR164 | No Apical Meristem | 400 | MRT3635_48601C.2 | G. hirsutum |
| miR164 | No Apical Meristem | 401 | MRT3635_64345C.1 | G. hirsutum |
| miR165/166 | class III HD-Zip protein | 402 | MRT3635_4809C.2 | G. hirsutum |
| miR165/166 | class III HD-Zip protein | 403 | MRT3635_50942C.2 | G. hirsutum |
| miR165/166 | class III HD-Zip protein | 404 | MRT3635_72188C.1 | G. hirsutum |
| miR166 | class III HD-Zip protein | 405 | MRT3635_12880C.2 | G. hirsutum |
| miR167 | Auxin Response Factor | 406 | MRT3635_13510C.2 | G. hirsutum |
| miR167 | Auxin Response Factor | 407 | MRT3635_14893C.2 | G. hirsutum |
| miR167 | Auxin Response Factor | 408 | MRT3635_24556C.2 | G. hirsutum |
| miR167 | Auxin Response Factor | 409 | MRT3635_59443C.1 | G. hirsutum |
| miR168 | AGO1 | 410 | MRT3635_43628C.2 | G. hirsutum |
| miR168 | Argonaute | 411 | MRT3635_68755C.1 | G. hirsutum |
| miR169 | CCAAT-binding | 412 | MRT3635_18720C.2 | G. hirsutum |
| miR169 | CCAAT-binding | 413 | MRT3635_60547_C.1 | G. hirsutum |
| miR169 | CCAAT-binding | 414 | MRT3635_63602C.1 | G. hirsutum |
| miR169 | CCAAT-binding | 415 | MRT3635_751C.2 | G. hirsutum |
| miR169 | nuclear transcription factor Y | 416 | MRT3635_57584C.1 | G. hirsutum |
| miR169 | nuclear transcription factor Y | 417 | MRT3635_63203C.1 | G. hirsutum |
| miR169 | nuclear transcription factor Y | 418 | MRT3635_67492C.1 | G. hirsutum |
| miR171 | GRAS | 419 | MRT3635_41132C.2 | G. hirsutum |
| miR172 | AP2 | 420 | MRT3635_50596C.2 | G. hirsutum |
| miR172 | AP2 domain | 421 | MRT3635_21738C.2 | G. hirsutum |
| miR172 | AP2 domain | 422 | MRT3635_5937C.2 | G. hirsutum |
| miR172 | AP2 domain | 423 | MRT3635_64989C.1 | G. hirsutum |
| miR172 | AP2 domain | 424 | MRT3635_8244C.2 | G. hirsutum |
| miR319 | TCP | 425 | MRT3635_31917C.2 | G. hirsutum |
| miR319 | TCP family transcription factor | 426 | MRT3635_40862C.2 | G. hirsutum |
| miR319 | TCP family transcription factor | 427 | MRT3635_55735C.1 | G. hirsutum |
| miR393 | TIR1 | 428 | MRT3635_18850C.2 | G. hirsutum |
| miR393 | TIR1 | 429 | MRT3635_35639C.2 | G. hirsutum |
| miR393 | TIR1 | 430 | MRT3635_68504C.1 | G. hirsutum |
| miR393 | Transport inhibitor response | 431 | MRT3635_18188C.2 | G. hirsutum |
| miR393 | Transport inhibitor response | 432 | MRT3635_49076C.2 | G. hirsutum |
| miR395 | AST | 433 | MRT3635_73824C.1 | G. hirsutum |
| miR395 | sulfate adenylyltransferase | 434 | MRT3635_15903C.2 | G. hirsutum |
| miR395 | sulfate adenylyltransferase | 435 | MRT3635_48567C.2 | G. hirsutum |
| miR395 | sulfate transporter | 436 | MRT3635_64866C.1 | G. hirsutum |
| miR396 | Growth-regulating factor | 437 | MRT3635_10089C.2 | G. hirsutum |
| miR396 | Growth-regulating factor | 438 | MRT3635_18322C.2 | G. hirsutum |
| miR396 | Growth-regulating factor | 439 | MRT3635_43733C.2 | G. hirsutum |
| miR396 | Growth-regulating factor | 440 | MRT3635_44225C.2 | G. hirsutum |
| miR396 | Growth-regulating factor | 441 | MRT3635_67643C.1 | G. hirsutum |
| miR396 | Growth-regulating factor | 442 | MRT3635_71085C.1 | G. hirsutum |
| miR396 | Growth-regulating factor | 443 | MRT3635_7854C.2 | G. hirsutum |
| miR397 | Laccase | 444 | MRT3635_2612C.2 | G. hirsutum |
| miR397 | Laccase | 445 | MRT3635_59330C.1 | G. hirsutum |
| miR397 | Laccase | 446 | MRT3635_62379C.1 | G. hirsutum |
| miR400 | PPR | 447 | MRT3635_14024C.2 | G. hirsutum |
| miR400 | PPR | 448 | MRT3635_24425C.2 | G. hirsutum |
| miR400 | PPR | 449 | MRT3635_62540C.1 | G. hirsutum |
| miR400 | PPR | 450 | MRT3635_71976C.1 | G. hirsutum |
| miR408 | blue copper protein | 451 | MRT3635_25321C.2 | G. hirsutum |

TABLE 2-continued

Computationally validated miRNA targets

| miRNA | Gene Function | SEQ ID NO: | Gene ID | Species of origin* |
|---|---|---|---|---|
| miR408 | blue copper protein | 452 | MRT3635_36078C.2 | G. hirsutum |
| miR408 | blue copper protein | 453 | MRT3635_36080C.2 | G. hirsutum |
| miR408 | blue copper protein | 454 | MRT3635_54561C.2 | G. hirsutum |
| miR408 | blue copper protein | 455 | MRT3635_54936C.2 | G. hirsutum |
| miR444 | MADS-box | 456 | MRT3635_52393C.1 | G. hirsutum |
| miR472 | ATP binding | 457 | MRT3635_16581C.2 | G. hirsutum |
| miR472/482 | NBS-LRR type disease resistance protein | 458 | MRT3635_77272C.1 | G. hirsutum |
| miR475 | pentatricopeptide | 459 | MRT3635_73944C.1 | G. hirsutum |
| miR475 | Pentatricopeptide repeat | 460 | MRT3635_35992C.1 | G. hirsutum |
| miR475 | Pentatricopeptide repeat | 461 | MRT3635_51055C.1 | G. hirsutum |
| miR475 | PPR | 462 | MRT3635_36232C.2 | G. hirsutum |
| miR475 | PPR | 463 | MRT3635_65837C.1 | G. hirsutum |
| miR475 | PPR | 464 | MRT3635_6832C.2 | G. hirsutum |
| miR827 | SPX | 465 | MRT3635_71336C.1 | G. hirsutum |
| miR827 | zinc finger | 466 | MRT3635_61225C.1 | G. hirsutum |
| miR828 | MYB | 467 | MRT3635_63902C.1 | G. hirsutum |
| miR828 | myb-like DNA-binding | 468 | MRT3635_11678C.2 | G. hirsutum |
| miR828 | myb-like DNA-binding | 469 | MRT3635_23974C.2 | G. hirsutum |
| miR828 | myb-like DNA-binding | 470 | MRT3635_37632C.1 | G. hirsutum |
| miR828 | myb-like DNA-binding | 471 | MRT3635_46849C.2 | G. hirsutum |
| miR828 | myb-like DNA-binding | 472 | MRT3635_75185C.1 | G. hirsutum |
| miR828/858 | MYB | 473 | MRT3635_12320C.2 | G. hirsutum |
| miR828/858 | myb-like DNA-binding | 474 | MRT3635_25669C.1 | G. hirsutum |
| miR858 | MYB | 475 | MRT3635_11888C.1 | G. hirsutum |
| miR858 | MYB | 476 | MRT3635_17735C.1 | G. hirsutum |
| miR858 | MYB | 477 | MRT3635_3345C.1 | G. hirsutum |
| miR858 | MYB | 478 | MRT3635_46789C.1 | G. hirsutum |
| miR858 | myb-like DNA-binding | 479 | MRT3635_48257C.1 | G. hirsutum |
| miR858 | myb-like DNA-binding | 480 | MRT3635_53024C.2 | G. hirsutum |
| miR858 | myb-like DNA-binding | 481 | MRT3635_55977C.1 | G. hirsutum |
| miR858 | myb-like DNA-binding | 482 | MRT3635_57077C.1 | G. hirsutum |
| miR858 | myb-like DNA-binding | 483 | MRT3635_66730C.1 | G. hirsutum |
| miR858 | myb-like DNA-binding | 484 | MRT3635_67640C.1 | G. hirsutum |
| miR858 | myb-like DNA-binding | 485 | MRT3635_69682C.1 | G. hirsutum |
| miR858 | myb-like DNA-binding | 486 | MRT3635_74072C.1 | G. hirsutum |
| miR156 | SBP domain | 487 | MRT4513_33353C.1 | Hordeum vulgare |
| miR156/157 | SBP domain | 488 | MRT4513_19757C.1 | H. vulgare |
| miR156/157 | SBP domain, miR157 | 489 | MRT4513_52153C.1 | H. vulgare |
| miR156/157 | SBP-domain, miR157 | 490 | MRT4513_41849C.1 | H. vulgare |
| miR156/157 | Squamosa Promoter Binding Protein | 491 | MRT4513_4449C.1 | H. vulgare |
| miR159 | myb-like DNA-binding domain | 492 | MRT4513_1572C.3 | H. vulgare |
| miR159 | myb-like DNA-binding domain | 493 | MRT4513_55409C.1 | H. vulgare |
| miR160 | Auxin Response Factor | 494 | MRT4513_43004C.1 | H. vulgare |
| miR160 | Auxin Response Factor | 495 | MRT4513_48930C.1 | H. vulgare |
| miR160 | Auxin Response Factor | 496 | MRT4513_51165C.1 | H. vulgare |
| miR160 | Auxin Response Factor | 497 | MRT4513_9322C.2 | H. vulgare |
| miR164 | NAC domain protein | 498 | MRT4513_51143C.2 | H. vulgare |
| miR164 | NAC domain protein | 499 | MRT4513_7890C.1 | H. vulgare |
| miR164 | No Apical Meristem | 500 | MRT4513_26199C.1 | H. vulgare |
| miR167 | Auxin Response Factor | 501 | MRT4513_29483C.2 | H. vulgare |
| miR167 | Auxin Response Factor | 502 | MRT4513_29827C.2 | H. vulgare |
| miR167 | Auxin Response Factor | 503 | MRT4513_31779C.1 | H. vulgare |
| miR167 | Auxin Response Factor | 504 | MRT4513_47791C.1 | H. vulgare |
| miR168 | Argonaute | 505 | MRT4513_31835C.1 | H. vulgare |
| miR168 | Argonaute | 506 | MRT4513_43289C.1 | H. vulgare |
| miR168 | PINHEAD | 507 | MRT4513_28709C.1 | H. vulgare |
| miR169 | CCAAT-binding | 508 | MRT4513_27452C.1 | H. vulgare |
| miR169 | CCAAT-binding | 509 | MRT4513_38912C.1 | H. vulgare |
| miR169 | CCAAT-binding | 510 | MRT4513_51394C.1 | H. vulgare |
| miR170/171 | SCL | 511 | MRT4513_44124C.1 | H. vulgare |
| miR172 | AP2 | 512 | MRT4513_6417C.1 | H. vulgare |
| miR172 | AP2 domain | 513 | MRT4513_42015C.1 | H. vulgare |
| miR319 | PCF | 514 | MRT4513_31590C.1 | H. vulgare |
| miR319 | PCF | 515 | MRT4513_52459C.1 | H. vulgare |
| miR393 | Transport inhibitor response | 516 | MRT4513_12741C.1 | H. vulgare |
| miR393 | Transport inhibitor response | 517 | MRT4513_38675C.1 | H. vulgare |
| miR394 | F-box | 518 | MRT4513_23211C.1 | H. vulgare |
| miR396 | Growth-regulating factor | 519 | MRT4513_20166C.2 | H. vulgare |
| miR396 | Growth-regulating factor | 520 | MRT4513_26009C.2 | H. vulgare |
| miR396 | Growth-regulating factor | 521 | MRT4513_33203C.1 | H. vulgare |
| miR396 | Growth-regulating factor | 522 | MRT4513_4600C.1 | H. vulgare |
| miR396 | Growth-regulating factor | 523 | MRT4513_50332C.1 | H. vulgare |
| miR397 | Laccase | 524 | MRT4513_35926C.1 | H. vulgare |
| miR397 | Laccase | 525 | MRT4513_40609C.1 | H. vulgare |

TABLE 2-continued

Computationally validated miRNA targets

| miRNA | Gene Function | SEQ ID NO: | Gene ID | Species of origin* |
|---|---|---|---|---|
| miR398 | Copper/zinc superoxide dismutase | 526 | MRT4513_43414C.2 | H. vulgare |
| miR398 | Copper/zinc superoxide dismutase | 527 | MRT4513_8559C.2 | H. vulgare |
| miR408 | blue copper protein | 528 | MRT4513_31098C.2 | H. vulgare |
| miR472 | NBS-LRR disease resistance protein | 529 | MRT4513_5784C.1 | H. vulgare |
| miR475 | pentatricopeptide | 530 | MRT4513_47541C.1 | H. vulgare |
| miR475 | PPR | 531 | MRT4513_7525C.2 | H. vulgare |
| miR482 | disease resistance | 532 | MRT4513_11673C.1 | H. vulgare |
| miR858 | myb-like DNA-binding | 533 | MRT4513_11055C.1 | H. vulgare |
| miR858 | myb-like DNA-binding | 534 | MRT4513_42246C.1 | H. vulgare |
| miR858 | myb-like DNA-binding | 535 | MRT4513_4767C.1 | H. vulgare |
| miR858 | myb-like DNA-binding | 536 | MRT4513_5642C.1 | H. vulgare |
| miR156/157 | SBP domain | 537 | MRT3880_19943C.1 | Medicago sativa |
| miR156/157 | SBP domain | 538 | MRT3880_34839C.1 | M. sativa |
| miR156/157 | SBP domain | 539 | MRT3880_54023C.1 | M. sativa |
| miR156/157 | Squamosa Promoter Binding Protein | 540 | MRT3880_59834C.1 | M. sativa |
| miR156/157 | Squamosa Promoter Binding Protein | 541 | MRT3880_62151C.1 | M. sativa |
| miR159 | myb-like DNA-binding domain | 542 | MRT3880_51095C.1 | M. sativa |
| miR160 | Auxin Response Factor | 543 | MRT3880_22965C.1 | M. sativa |
| miR160 | Auxin Response Factor | 544 | MRT3880_28718C.1 | M. sativa |
| miR160 | Auxin Response Factor | 545 | MRT3880_38543C.1 | M. sativa |
| miR160 | Auxin Response Factor | 546 | MRT3880_44036C.1 | M. sativa |
| miR161 | PPR | 547 | MRT3880_11000C.1 | M. sativa |
| miR161/475 | Pentatricopeptide repeat | 548 | MRT3880_37878C.1 | M. sativa |
| miR162 | Dicer | 549 | MRT3880_26893C.1 | M. sativa |
| miR164 | NAC domain protein | 550 | MRT3880_18003C.2 | M. sativa |
| miR164 | No Apical Meristem | 551 | MRT3880_44619C.1 | M. sativa |
| miR165/166 | class III HD-Zip protein | 552 | MRT3880_37546C.1 | M. sativa |
| miR165/166 | class III HD-Zip protein | 553 | MRT3880_39764C.1 | M. sativa |
| miR167 | Auxin Response Factor | 554 | MRT3880_12926C.1 | M. sativa |
| miR167 | Auxin Response Factor | 555 | MRT3880_17672C.1 | M. sativa |
| miR167 | Auxin Response Factor | 556 | MRT3880_25270C.1 | M. sativa |
| miR167 | Auxin Response Factor | 557 | MRT3880_30476C.1 | M. sativa |
| miR167 | Auxin Response Factor | 558 | MRT3880_36150C.1 | M. sativa |
| miR167 | Auxin Response Factor | 559 | MRT3880_470C.1 | M. sativa |
| miR169 | nuclear transcription factor Y | 560 | MRT3880_16272C.2 | M. sativa |
| miR169 | nuclear transcription factor Y | 561 | MRT3880_21811C.2 | M. sativa |
| miR169 | nuclear transcription factor Y | 562 | MRT3880_59679C.1 | M. sativa |
| miR170/171 | GRAS | 563 | MRT3880_12452C.1 | M. sativa |
| miR170/171 | GRAS | 564 | MRT3880_29125C.1 | M. sativa |
| miR170/171 | GRAS | 565 | MRT3880_31130C.1 | M. sativa |
| miR170/171 | GRAS | 566 | MRT3880_40896C.1 | M. sativa |
| miR170/171 | GRAS | 567 | MRT3880_63440C.1 | M. sativa |
| miR172 | AP2 domain | 568 | MRT3880_36568C.1 | M. sativa |
| miR172 | AP2 domain | 569 | MRT3880_39959C.1 | M. sativa |
| miR172 | AP2 domain | 570 | MRT3880_55789C.1 | M. sativa |
| miR319 | TCP | 571 | MRT3880_2628C.1 | M. sativa |
| miR319 | TCP family transcription factor | 572 | MRT3880_44480C.1 | M. sativa |
| miR393 | Transport inhibitor response | 573 | MRT3880_18564C.2 | M. sativa |
| miR393 | Transport inhibitor response | 574 | MRT3880_38847C.1 | M. sativa |
| miR393 | Transport inhibitor response | 575 | MRT3880_67369C.1 | M. sativa |
| miR396 | Growth-regulating factor | 576 | MRT3880_18861C.1 | M. sativa |
| miR396 | Growth-regulating factor | 577 | MRT3880_22460C.1 | M. sativa |
| miR396 | Growth-regulating factor | 578 | MRT3880_41297C.1 | M. sativa |
| miR397 | Laccase | 579 | MRT3880_43121C.1 | M. sativa |
| miR397 | Laccase | 580 | MRT3880_56114C.2 | M. sativa |
| miR400 | pentatricopeptide | 581 | MRT3880_53970C.1 | M. sativa |
| miR400 | PPR | 582 | MRT3880_14263C.1 | M. sativa |
| miR400 | PPR | 583 | MRT3880_65540C.1 | M. sativa |
| miR400/475 | Pentatricopeptide repeat | 584 | MRT3880_27459C.1 | M. sativa |
| miR400/475 | Pentatricopeptide repeat | 585 | MRT3880_49876C.1 | M. sativa |
| miR400/475 | PPR | 586 | MRT3880_44329C.1 | M. sativa |
| miR408 | blue copper protein | 587 | MRT3880_46744C.2 | M. sativa |
| miR408 | blue copper protein | 588 | MRT3880_53025C.1 | M. sativa |
| miR408 | blue copper protein | 589 | MRT3880_5838C.1 | M. sativa |
| miR472 | ATP binding | 590 | MRT3880_29560C.1 | M. sativa |
| miR472 | ATP binding | 591 | MRT3880_30961C.1 | M. sativa |
| miR472 | ATP binding | 592 | MRT3880_48315C.1 | M. sativa |
| miR472 | ATP binding | 593 | MRT3880_53199C.1 | M. sativa |
| miR472 | ATP binding | 594 | MRT3880_54030C.2 | M. sativa |
| miR472 | ATP binding | 595 | MRT3880_57442C.1 | M. sativa |
| miR472 | disease resistance protein | 596 | MRT3880_10080C.1 | M. sativa |
| miR472 | disease resistance protein | 597 | MRT3880_12559C.2 | M. sativa |
| miR472 | disease resistance protein | 598 | MRT3880_17698C.1 | M. sativa |
| miR472 | disease resistance protein | 599 | MRT3880_21650C.1 | M. sativa |
| miR472 | disease resistance protein | 600 | MRT3880_22933C.1 | M. sativa |

TABLE 2-continued

Computationally validated miRNA targets

| miRNA | Gene Function | SEQ ID NO: | Gene ID | Species of origin* |
|---|---|---|---|---|
| miR472 | disease resistance protein | 601 | MRT3880_26007C.1 | *M. sativa* |
| miR472 | disease resistance protein | 602 | MRT3880_28379C.1 | *M. sativa* |
| miR472 | disease resistance protein | 603 | MRT3880_3002C.1 | *M. sativa* |
| miR472 | disease resistance protein | 604 | MRT3880_38354C.1 | *M. sativa* |
| miR472 | disease resistance protein | 605 | MRT3880_41496C.1 | *M. sativa* |
| miR472 | disease resistance protein | 606 | MRT3880_51100C.1 | *M. sativa* |
| miR472 | disease resistance protein | 607 | MRT3880_5498C.1 | *M. sativa* |
| miR472 | disease resistance protein | 608 | MRT3880_59891C.1 | *M. sativa* |
| miR472 | NBS-LRR type disease resistance protein | 609 | MRT3880_45204C.1 | *M. sativa* |
| miR472 | NBS-LRR type disease resistance protein | 610 | MRT3880_52654C.1 | *M. sativa* |
| miR472 | NBS-LRR type disease resistance protein | 611 | MRT3880_66600C.1 | *M. sativa* |
| miR472 | NBS-LRR type disease resistance protein | 612 | MRT3880_7642C.1 | *M. sativa* |
| miR472/482 | disease resistance protein | 613 | MRT3880_19707C.1 | *M. sativa* |
| miR472/482 | disease resistance protein | 614 | MRT3880_19814C.1 | *M. sativa* |
| miR472/482 | disease resistance protein | 615 | MRT3880_26877C.1 | *M. sativa* |
| miR472/482 | disease resistance protein | 616 | MRT3880_2935C.1 | *M. sativa* |
| miR472/482 | disease resistance protein | 617 | MRT3880_36417C.1 | *M. sativa* |
| miR472/482 | disease resistance protein | 618 | MRT3880_44875C.1 | *M. sativa* |
| miR472/482 | disease resistance protein | 619 | MRT3880_5004C.1 | *M. sativa* |
| miR472/482 | disease resistance protein | 620 | MRT3880_52723C.1 | *M. sativa* |
| miR472/482 | disease resistance protein | 621 | MRT3880_57846C.1 | *M. sativa* |
| miR472/482 | disease resistance protein | 622 | MRT3880_63259C.1 | *M. sativa* |
| miR472/482 | disease resistance protein | 623 | MRT3880_6363C.1 | *M. sativa* |
| miR472/482 | disease resistance protein | 624 | MRT3880_65083C.1 | *M. sativa* |
| miR472/482, miR779 | disease resistance protein, leucine rich repeat | 625 | MRT3880_55187C.1 | *M. sativa* |
| miR475 | Pentatricopeptide repeat | 626 | MRT3880_13183C.1 | *M. sativa* |
| miR475 | Pentatricopeptide repeat | 627 | MRT3880_42014C.1 | *M. sativa* |
| miR475 | Pentatricopeptide repeat | 628 | MRT3880_46171C.1 | *M. sativa* |
| miR475 | PPR | 629 | MRT3880_12164C.1 | *M. sativa* |
| miR475 | PPR | 630 | MRT3880_12471C.1 | *M. sativa* |
| miR475 | PPR | 631 | MRT3880_16503C.1 | *M. sativa* |
| miR475 | PPR | 632 | MRT3880_22609C.1 | *M. sativa* |
| miR475 | PPR | 633 | MRT3880_35917C.1 | *M. sativa* |
| miR475 | PPR | 634 | MRT3880_39210C.1 | *M. sativa* |
| miR475 | PPR | 635 | MRT3880_55838C.1 | *M. sativa* |
| miR475 | PPR | 636 | MRT3880_56789C.1 | *M. sativa* |
| miR475 | PPR | 637 | MRT3880_65802C.1 | *M. sativa* |
| miR475 | PPR | 638 | MRT3880_870C.1 | *M. sativa* |
| miR475 | PPR | 639 | MRT3880_9632C.1 | *M. sativa* |
| miR476 | Pentatricopeptide repeat | 640 | MRT3880_13782C.1 | *M. sativa* |
| miR477 | GRAS | 641 | MRT3880_1038C.1 | *M. sativa* |
| miR477 | GRAS | 642 | MRT3880_14765C.1 | *M. sativa* |
| miR477 | GRAS | 643 | MRT3880_28393C.1 | *M. sativa* |
| miR477 | GRAS | 644 | MRT3880_31231C.1 | *M. sativa* |
| miR477 | GRAS | 645 | MRT3880_42028C.1 | *M. sativa* |
| miR477 | GRAS | 646 | MRT3880_51782C.1 | *M. sativa* |
| miR482 | disease resistance protein | 647 | MRT3880_12508C.1 | *M. sativa* |
| miR482 | disease resistance protein | 648 | MRT3880_16156C.1 | *M. sativa* |
| miR482 | disease resistance protein | 649 | MRT3880_22305C.1 | *M. sativa* |
| miR482 | disease resistance protein | 650 | MRT3880_30579C.1 | *M. sativa* |
| miR482 | disease resistance protein | 651 | MRT3880_38019C.1 | *M. sativa* |
| miR482 | disease resistance protein | 652 | MRT3880_4159C.1 | *M. sativa* |
| miR482 | disease resistance protein | 653 | MRT3880_49695C.1 | *M. sativa* |
| miR482 | disease resistance protein | 654 | MRT3880_54965C.1 | *M. sativa* |
| miR482 | disease resistance protein | 655 | MRT3880_56400C.1 | *M. sativa* |
| miR482 | disease resistance protein | 656 | MRT3880_56673C.1 | *M. sativa* |
| miR482 | disease resistance protein | 657 | MRT3880_58830C.1 | *M. sativa* |
| miR482 | disease resistance protein | 658 | MRT3880_58849C.1 | *M. sativa* |
| miR482 | disease resistance protein | 659 | MRT3880_59857C.1 | *M. sativa* |
| miR482 | disease resistance protein | 660 | MRT3880_60136C.1 | *M. sativa* |
| miR482 | disease resistance protein | 661 | MRT3880_65552C.2 | *M. sativa* |
| miR482 | disease resistance protein | 662 | MRT3880_8722C.1 | *M. sativa* |
| miR482 | disease resistance protein | 663 | MRT3880_9618C.1 | *M. sativa* |
| miR828 | myb-like DNA-binding | 664 | MRT3880_19611C.1 | *M. sativa* |
| miR858 | myb-like DNA-binding | 665 | MRT3880_10365C.1 | *M. sativa* |
| miR858 | myb-like DNA-binding | 666 | MRT3880_12267C.1 | *M. sativa* |
| miR858 | myb-like DNA-binding | 667 | MRT3880_19438C.1 | *M. sativa* |
| miR858 | myb-like DNA-binding | 668 | MRT3880_23642C.1 | *M. sativa* |
| miR858 | myb-like DNA-binding | 669 | MRT3880_33147C.1 | *M. sativa* |
| miR858 | myb-like DNA-binding | 670 | MRT3880_34889C.1 | *M. sativa* |

TABLE 2-continued

Computationally validated miRNA targets

| miRNA | Gene Function | SEQ ID NO: | Gene ID | Species of origin* |
|---|---|---|---|---|
| miR858 | myb-like DNA-binding | 671 | MRT3880_39946C.1 | M. sativa |
| miR858 | myb-like DNA-binding | 672 | MRT3880_55009C.1 | M. sativa |
| miR858 | myb-like DNA-binding | 673 | MRT3880_56414C.1 | M. sativa |
| miR858 | myb-like DNA-binding | 674 | MRT3880_62538C.1 | M. sativa |
| miR858 | myb-like DNA-binding | 675 | MRT3880_801C.1 | M. sativa |
| miR858 | myb-like DNA-binding | 676 | MRT3880_8393C.1 | M. sativa |
| miR859 | F-box protein | 677 | MRT3880_46176C.1 | M. sativa |
| miR859 | F-box protein | 678 | MRT3880_47002C.1 | M. sativa |
| miRMON13 | PPR | 679 | MRT3880_52640C.1 | M. sativa |
| miRMON13 | PPR | 680 | MRT3880_60915C.1 | M. sativa |
| miR156 | SBP domain | 681 | MRT4530_118092C.3 | Oryza sativa |
| miR156 | SBP domain | 682 | MRT4530_135991C.4 | O. sativa |
| miR156 | SBP domain | 683 | MRT4530_257640C.1 | O. sativa |
| miR156 | SBP-domain | 684 | MRT4530_142142C.4 | O. sativa |
| miR156 | Squamosa Promoter Binding Protein | 685 | MRT4530_195506C.2 | O. sativa |
| miR156 | Squamosa Promoter Binding Protein | 686 | MRT4530_220364C.2 | O. sativa |
| miR156 | Squamosa Promoter Binding Protein | 687 | MRT4530_236277C.1 | O. sativa |
| miR156 | Squamosa Promoter Binding Protein | 688 | MRT4530_53217C.5 | O. sativa |
| miR156 | Squamosa Promoter Binding Protein | 689 | MRT4530_6964C.4 | O. sativa |
| miR159 | MYB | 690 | MRT4530_103606C.2 | O. sativa |
| miR159 | myb-like | 691 | MRT4530_82994C.2 | O. sativa |
| miR159 | myb-like DNA-binding domain | 692 | MRT4530_103605C.3 | O. sativa |
| miR159 | myb-like DNA-binding domain | 693 | MRT4530_156102C.3 | O. sativa |
| miR159 | myb-like DNA-binding domain | 694 | MRT4530_181046C.3 | O. sativa |
| miR159 | myb-like DNA-binding domain | 695 | MRT4530_42135C.5 | O. sativa |
| miR160 | ARF | 696 | PHE0003527 | O. sativa |
| miR160 | ARF | 697 | PHE0003528 | O. sativa |
| miR160 | Auxin Response Factor | 698 | MRT4530_228913C.1 | O. sativa |
| miR160 | Auxin Response Factor | 699 | MRT4530_69952C.4 | O. sativa |
| miR160 | Auxin Response Factor | 700 | MRT4530_71017C.4 | O. sativa |
| miR160 | Auxin Response Factor | 701 | MRT4530_75962C.5 | O. sativa |
| miR162 | CAF | 702 | MRT4530_212066C.2 | O. sativa |
| miR164 | NAC | 703 | MRT4530_224181C.2 | O. sativa |
| miR164 | NAC domain protein | 704 | MRT4530_178256C.3 | O. sativa |
| miR164 | NAC domain protein | 705 | MRT4530_221769C.1 | O. sativa |
| miR164 | NAC1 | 706 | MRT4530_141528C.5 | O. sativa |
| miR164 | No Apical Meristem | 707 | MRT4530_147737C.4 | O. sativa |
| miR164 | No Apical Meristem | 708 | MRT4530_157393C.3 | O. sativa |
| miR166 | HD-ZIP | 709 | MRT4530_253068C.2 | O. sativa |
| miR167 | ARF | 710 | PHE0003657 | O. sativa |
| miR167 | Auxin Response Factor | 711 | MRT4530_86291C.3 | O. sativa |
| miR168 | Argonaute | 712 | MRT4530_147864C.3 | O. sativa |
| miR169 | CCAAT-binding | 713 | MRT4530_156068C.3 | O. sativa |
| miR169 | CCAAT-binding | 714 | MRT4530_52650C.3 | O. sativa |
| miR169 | CCAAT-binding | 715 | MRT4530_98042C.6 | O. sativa |
| miR171 | GRAS | 716 | MRT4530_157676C.3 | O. sativa |
| miR171 | GRAS | 717 | MRT4530_159257C.2 | O. sativa |
| miR171 | GRAS | 718 | MRT4530_177712C.1 | O. sativa |
| miR171 | GRAS | 719 | MRT4530_64038C.2 | O. sativa |
| miR171 | Scarecrow-like | 720 | MRT4530_146050C.4 | O. sativa |
| miR171 | SCL | 721 | MRT4530_111185C.3 | O. sativa |
| miR171 | SCL | 722 | MRT4530_12928C.2 | O. sativa |
| miR171 | SCL | 723 | MRT4530_88963C.6 | O. sativa |
| miR172 | AP2 | 724 | PHE0003882 | O. sativa |
| miR172 | AP2 domain | 725 | MRT4530_160275C.3 | O. sativa |
| miR172 | AP2 domain | 726 | MRT4530_56773C.3 | O. sativa |
| miR319 | TCP family transcription factor | 727 | MRT4530_154891C.2 | O. sativa |
| miR319 | TCP family transcription factor | 728 | MRT4530_9431C.5 | O. sativa |
| miR319 | TCP3 | 729 | MRT4530_151800C.2 | O. sativa |
| miR393 | Transport inhibitor response | 730 | MRT4530_241313C.2 | O. sativa |
| miR395 | ATP sulfurylase | 731 | MRT4530_16384C.4 | O. sativa |
| miR395 | sulfate transporter | 732 | MRT4530_33633C.6 | O. sativa |
| miR396 | Growth-regulating factor | 733 | PHE0000026 | O. sativa |
| miR396 | Growth-regulating factor | 734 | MRT4530_140789C.3 | O. sativa |
| miR396 | Growth-regulating factor | 735 | MRT4530_145151C.4 | O. sativa |
| miR396 | Growth-regulating factor | 736 | MRT4530_147352C.3 | O. sativa |
| miR396 | Growth-regulating factor | 737 | MRT4530_180707C.1 | O. sativa |
| miR396 | Growth-regulating factor | 738 | MRT4530_221461C.1 | O. sativa |
| miR396 | Growth-regulating factor | 739 | MRT4530_63308C.3 | O. sativa |
| miR396 | Growth-regulating factor | 740 | MRT4530_73195C.3 | O. sativa |
| miR396 | Growth-regulating factor | 741 | MRT4530_83576C.4 | O. sativa |
| miR397 | Laccase | 742 | MRT4530_148379C.4 | O. sativa |
| miR397 | Laccase | 743 | MRT4530_181828C.1 | O. sativa |
| miR397 | Laccase | 744 | MRT4530_237569C.1 | O. sativa |
| miR397 | Laccase | 745 | MRT4530_60143C.3 | O. sativa |

TABLE 2-continued

Computationally validated miRNA targets

| miRNA | Gene Function | SEQ ID NO: | Gene ID | Species of origin* |
|---|---|---|---|---|
| miR408 | blue copper protein | 746 | MRT4530_137979C.3 | O. sativa |
| miR408 | blue copper protein | 747 | MRT4530_260849C.1 | O. sativa |
| miR408 | blue copper protein | 748 | MRT4530_40477C.6 | O. sativa |
| miR408 | Laccase | 749 | MRT4530_160612C.2 | O. sativa |
| miR408 | Laccase | 750 | MRT4530_169405C.1 | O. sativa |
| miR444 | MADS | 751 | MRT4530_27947C.3 | O. sativa |
| miR444 | MADS | 752 | MRT4530_78475C.3 | O. sativa |
| miR444 | MADS box | 753 | PHE0001381 | O. sativa |
| miR444 | MADS box | 754 | PHE0015548 | O. sativa |
| miR444 | MADS box | 755 | PHE0015549 | O. sativa |
| miR444 | MADS-box | 756 | PHE0003829 | O. sativa |
| miR444 | MADS-box | 757 | MRT4530_196636C.3 | O. sativa |
| miR809 | Mlo | 758 | MRT4530_59197C.5 | O. sativa |
| miR538 | MADS-box | 759 | PHE0014613 | Physcomitrella patens |
| miR156/157 | SBP domain | 760 | MRT4558_6587C.1 | Sorghum bicolor |
| miR156/157 | SBP-domain | 761 | MRT4558_12680C.1 | S. bicolor |
| miR156/157 | Squamosa Promoter Binding Protein | 762 | MRT4558_8644C.2 | S. bicolor |
| miR159 | GAMYB | 763 | MRT4558_37619C.1 | S. bicolor |
| miR160 | Auxin Response Factor | 764 | MRT4558_27799C.1 | S. bicolor |
| miR164 | NAC domain protein | 765 | MRT4558_43436C.1 | S. bicolor |
| miR164 | NAC domain protein | 766 | MRT4558_4564C.2 | S. bicolor |
| miR164 | NAC1 | 767 | MRT4558_43081C.1 | S. bicolor |
| miR164 | No Apical Meristem | 768 | MRT4558_41467C.1 | S. bicolor |
| miR165/166 | class III HD-Zip protein | 769 | MRT4558_27560C.1 | S. bicolor |
| miR167 | Auxin Response Factor | 770 | MRT4558_10718C.3 | S. bicolor |
| miR167 | Auxin Response Factor | 771 | MRT4558_1659C.2 | S. bicolor |
| miR167 | Auxin Response Factor | 772 | MRT4558_37108C.1 | S. bicolor |
| miR169 | CCAAT-binding | 773 | MRT4558_11671C.2 | S. bicolor |
| miR169 | CCAAT-binding | 774 | MRT4558_13240C.2 | S. bicolor |
| miR169 | CCAAT-binding | 775 | MRT4558_19368C.2 | S. bicolor |
| miR169 | CCAAT-binding | 776 | MRT4558_8287C.2 | S. bicolor |
| miR170/171 | SCL | 777 | MRT4558_7655C.1 | S. bicolor |
| miR172 | AP2 domain | 778 | MRT4558_25704C.2 | S. bicolor |
| miR393 | Transport inhibitor response | 779 | MRT4558_1226C.2 | S. bicolor |
| miR393 | Transport inhibitor response | 780 | MRT4558_20000C.2 | S. bicolor |
| miR394 | F-box domain | 781 | MRT4558_11973C.2 | S. bicolor |
| miR395 | sulfate adenylyltransferase | 782 | MRT4558_11861C.1 | S. bicolor |
| miR395 | Sulfate transporter | 783 | MRT4558_24400C.2 | S. bicolor |
| miR396 | Growth-regulating factor | 784 | MRT4558_13321C.2 | S. bicolor |
| miR400 | Pentatricopeptide repeat | 785 | MRT4558_43831C.1 | S. bicolor |
| miR408 | blue copper protein | 786 | MRT4558_16166C.2 | S. bicolor |
| miR408 | blue copper protein | 787 | MRT4558_8981C.2 | S. bicolor |
| miR408 | Laccase | 788 | MRT4558_40844C.1 | S. bicolor |
| miR444 | MADS-box | 789 | MRT4558_11440C.2 | S. bicolor |
| miR472 | ATP binding | 790 | MRT4558_33723C.1 | S. bicolor |
| miR475 | PPR | 791 | MRT4558_5261C.2 | S. bicolor |
| miR536 | F-box protein | 792 | MRT4558_34710C.1 | S. bicolor |
| miR858 | myb-like DNA-binding | 793 | MRT4558_5881C.2 | S. bicolor |
| miR858 | myb-like DNA-binding | 794 | MRT4558_642C.1 | S. bicolor |
| miR159 | myb protein | 795 | MRT4565_281735C.1 | Triticum aestivum |
| miR169 | CCAAT | 796 | MRT4565_240119C.2 | T. aestivum |
| miR169 | CCAAT | 797 | MRT4565_270644C.2 | T. aestivum |
| miR172 | AP2 | 798 | MRT4565_247090C.1 | T. aestivum |
| miR394 | F-box | 799 | MRT4565_259298C.2 | T. aestivum |
| miR444 | MADS box | 800 | PHE0002649 | T. aestivum |
| miR444 | MADS-box | 801 | MRT4565_247066C.1 | T. aestivum |
| miR444 | MADS-box | 802 | MRT4565_258649C.1 | T. aestivum |
| miR529 | AP2 | 803 | MRT4565_278632C.2 | T. aestivum |
| miR858 | MYB | 804 | MRT4565_223049C.1 | T. aestivum |
| miR165/166 | REV | 805 | PHE0012638 | unidentified |
| miR824 | MADS box | 806 | PHE0015528 | unidentified |
| miR824 | MADS box | 807 | PHE0015545 | unidentified |
| miR1029 | erf | 808 | MRT4577_148956C.8 | Zea mays |
| miR1029 | erf | 809 | MRT4577_267494C.5 | Z. mays |
| miR1029 | erf | 810 | MRT4577_389477C.2 | Z. mays |
| miR1029 | erf | 811 | MRT4577_48700C.7 | Z. mays |
| miR1029 | erf | 812 | MRT4577_565542C.1 | Z. mays |
| miR1029 | erf | 813 | MRT4577_600239C.1 | Z. mays |
| miR156 | Squamosa Promoter Binding | 814 | MRT4577_396357C.4 | Z. mays |
| miR156/157 | SBP domain | 815 | MRT4577_122478C.6 | Z. mays |
| miR156/157 | SBP domain | 816 | MRT4577_270892C.4 | Z. mays |
| miR156/157 | SBP domain | 817 | MRT4577_334372C.5 | Z. mays |
| miR156/157 | SBP domain | 818 | MRT4577_532824C.3 | Z. mays |
| miR156/157 | SBP domain | 819 | MRT4577_535297C.2 | Z. mays |

TABLE 2-continued

Computationally validated miRNA targets

| miRNA | Gene Function | SEQ ID NO: | Gene ID | Species of origin* |
|---|---|---|---|---|
| miR156/157 | SBP domain | 820 | MRT4577_537670C.2 | Z. mays |
| miR156/157 | SBP domain | 821 | MRT4577_565057C.1 | Z. mays |
| miR156/157 | SBP domain | 822 | MRT4577_568647C.1 | Z. mays |
| miR156/157 | SBP domain | 823 | MRT4577_571545C.1 | Z. mays |
| miR156/157 | SBP domain | 824 | MRT4577_644419C.1 | Z. mays |
| miR156/157 | SBP-domain | 825 | MRT4577_23629C.7 | Z. mays |
| miR156/157 | SBP-domain | 826 | MRT4577_295538C.7 | Z. mays |
| miR156/157 | SBP-domain | 827 | MRT4577_31704C.9 | Z. mays |
| miR156/157 | Squamosa Promoter Binding | 828 | MRT4577_427964C.4 | Z. mays |
| miR156/157 | Squamosa Promoter Binding | 829 | MRT4577_461098C.3 | Z. mays |
| miR156/157 | Squamosa Promoter Binding Protein | 830 | MRT4577_137984C.6 | Z. mays |
| miR156/157 | Squamosa Promoter Binding Protein | 831 | MRT4577_188360C.6 | Z. mays |
| miR156/157 | Squamosa Promoter Binding Protein | 832 | MRT4577_205098C.7 | Z. mays |
| miR156/157 | Squamosa Promoter Binding Protein | 833 | MRT4577_26483C.7 | Z. mays |
| miR156/157 | Squamosa Promoter Binding Protein | 834 | MRT4577_341149C.6 | Z. mays |
| miR156/157 | Squamosa Promoter Binding Protein | 835 | MRT4577_383301C.4 | Z. mays |
| miR156/157 | Squamosa Promoter Binding Protein | 836 | MRT4577_42534C.9 | Z. mays |
| miR156/157 | Squamosa Promoter Binding Protein | 837 | MRT4577_564644C.1 | Z. mays |
| miR156/157 | Squamosa Promoter Binding Protein | 838 | MRT4577_619443C.1 | Z. mays |
| miR156/157 | Squamosa Promoter-Binding | 839 | MRT4577_333683C.4 | Z. mays |
| miR156/157 | Squamosa Promoter-Binding | 840 | MRT4577_38044C.8 | Z. mays |
| miR156/157 | teosinte glume architecture | 841 | MRT4577_181019C.5 | Z. mays |
| miR156/157 | teosinte glume architecture | 842 | MRT4577_78773C.8 | Z. mays |
| miR159 | GAMYB | 843 | MRT4577_481577C.2 | Z. mays |
| miR159 | MYB | 844 | MRT4577_210747C.5 | Z. mays |
| miR159 | MYB | 845 | MRT4577_542744C.2 | Z. mays |
| miR159 | myb-like | 846 | MRT4577_298452C.5 | Z. mays |
| miR159 | myb-like DNA-binding | 847 | MRT4577_565447C.1 | Z. mays |
| miR159 | myb-like DNA-binding | 848 | MRT4577_565456C.1 | Z. mays |
| miR159 | myb-like DNA-binding domain | 849 | MRT4577_30813C.8 | Z. mays |
| miR159 | myb-like DNA-binding domain | 850 | MRT4577_390477C.4 | Z. mays |
| miR159 | myb-like DNA-binding domain | 851 | MRT4577_391124C.5 | Z. mays |
| miR159 | myb-like DNA-binding domain | 852 | MRT4577_416957C.3 | Z. mays |
| miR159 | myb-like DNA-binding domain | 853 | MRT4577_545477C.2 | Z. mays |
| miR159 | myb-like DNA-binding domain | 854 | MRT4577_582653C.1 | Z. mays |
| miR159 | myb-like DNA-binding domain | 855 | MRT4577_598088C.1 | Z. mays |
| miR159 | myb-like DNA-binding domain | 856 | MRT4577_605039C.1 | Z. mays |
| miR159 | myb-like DNA-binding domain | 857 | MRT4577_613992C.1 | Z. mays |
| miR159 | myb-like DNA-binding domain | 858 | MRT4577_622542C.1 | Z. mays |
| miR159 | myb-like DNA-binding domain | 859 | MRT4577_709777C.1 | Z. mays |
| miR159 | myb-like DNA-binding domain | 860 | MRT4577_77765C.6 | Z. mays |
| miR160 | Auxin Response Factor | 861 | MRT4577_256734C.4 | Z. mays |
| miR160 | Auxin Response Factor | 862 | MRT4577_258637C.3 | Z. mays |
| miR160 | Auxin Response Factor | 863 | MRT4577_385317C.4 | Z. mays |
| miR160 | Auxin Response Factor | 864 | MRT4577_400043C.5 | Z. mays |
| miR160 | Auxin Response Factor | 865 | MRT4577_41620C.7 | Z. mays |
| miR160 | Auxin Response Factor | 866 | MRT4577_429671C.4 | Z. mays |
| miR160 | Auxin Response Factor | 867 | MRT4577_430512C.4 | Z. mays |
| miR160 | Auxin Response Factor | 868 | MRT4577_448022C.1 | Z. mays |
| miR160 | Auxin Response Factor | 869 | MRT4577_503622C.2 | Z. mays |
| miR160 | Auxin Response Factor | 870 | MRT4577_569655C.1 | Z. mays |
| miR160 | Auxin Response Factor | 871 | MRT4577_605037C.1 | Z. mays |
| miR161 | PPR | 872 | MRT4577_219343C.5 | Z. mays |
| miR161 | PPR | 873 | MRT4577_338127C.1 | Z. mays |
| miR161 | PPR | 874 | MRT4577_381918C.5 | Z. mays |
| miR161 | PPR | 875 | MRT4577_549370C.2 | Z. mays |
| miR161 | PPR | 876 | MRT4577_653452C.1 | Z. mays |
| miR162 | Dicer | 877 | MRT4577_226226C.4 | Z. mays |
| miR162 | Dicer | 878 | MRT4577_50615C.6 | Z. mays |
| miR162 | Dicer | 879 | MRT4577_592675C.1 | Z. mays |
| miR164 | NAC domain protein | 880 | MRT4577_686098C.1 | Z. mays |
| miR164 | NAC domain protein | 881 | MRT4577_98755C.5 | Z. mays |
| miR164 | NAC1 | 882 | PHE0003788 | Z. mays |
| miR164 | No Apical Meristem | 883 | MRT4577_105083C.9 | Z. mays |
| miR164 | No Apical Meristem | 884 | MRT4577_16045C.7 | Z. mays |
| miR164 | No Apical Meristem | 885 | MRT4577_256695C.4 | Z. mays |
| miR164 | No Apical Meristem | 886 | MRT4577_29326C.8 | Z. mays |
| miR164 | No Apical Meristem | 887 | MRT4577_317955C.5 | Z. mays |
| miR164 | No Apical Meristem | 888 | MRT4577_370828C.5 | Z. mays |
| miR164 | No Apical Meristem | 889 | MRT4577_394716C.4 | Z. mays |
| miR164 | No Apical Meristem | 890 | MRT4577_586054C.1 | Z. mays |
| miR164 | No Apical Meristem | 891 | MRT4577_625707C.1 | Z. mays |
| miR164 | No Apical Meristem | 892 | MRT4577_629408C.1 | Z. mays |
| miR164 | No Apical Meristem | 893 | MRT4577_705865C.1 | Z. mays |
| miR164 | No Apical Meristem | 894 | MRT4577_9951C.8 | Z. mays |

TABLE 2-continued

Computationally validated miRNA targets

| miRNA | Gene Function | SEQ ID NO: | Gene ID | Species of origin* |
|---|---|---|---|---|
| miR165/166 | class III HD-Zip protein | 895 | MRT4577_197925C.4 | Z. mays |
| miR165/166 | class III HD-Zip protein | 896 | MRT4577_200605C.3 | Z. mays |
| miR165/166 | class III HD-Zip protein | 897 | MRT4577_320718C.6 | Z. mays |
| miR165/166 | class III HD-Zip protein | 898 | MRT4577_43102C.9 | Z. mays |
| miR165/166 | class III HD-Zip protein | 899 | MRT4577_535928C.2 | Z. mays |
| miR165/166 | class III HD-Zip protein | 900 | MRT4577_568616C.1 | Z. mays |
| miR165/166 | class III HD-Zip protein | 901 | MRT4577_613062C.1 | Z. mays |
| miR165/166 | class III HD-Zip protein | 902 | MRT4577_659410C.1 | Z. mays |
| miR165/166 | class III HD-Zip protein | 903 | MRT4577_673351C.1 | Z. mays |
| miR165/166 | HD-ZIP | 904 | PHE0008043 | Z. mays |
| miR165/166 | Rev | 905 | PHE0007773 | Z. mays |
| miR165/166 | Rev | 906 | PHE0012657 | Z. mays |
| miR165/166 | rolled leaf | 907 | MRT4577_229497C.6 | Z. mays |
| miR165/166 | rolled leaf | 908 | MRT4577_312384C.3 | Z. mays |
| miR165/166 | rolled leaf | 909 | MRT4577_342259C.4 | Z. mays |
| miR165/166 | rolled leaf | 910 | MRT4577_442838C.4 | Z. mays |
| miR165/166 | rolled leaf | 911 | MRT4577_535676C.2 | Z. mays |
| miR165/166 | rolled leaf | 912 | MRT4577_566770C.1 | Z. mays |
| miR165/166 | rolled leaf | 913 | MRT4577_586718C.1 | Z. mays |
| miR167 | ARF | 914 | PHE0003656 | Z. mays |
| miR167 | Auxin Response Factor | 915 | MRT4577_267543C.4 | Z. mays |
| miR167 | Auxin Response Factor | 916 | MRT4577_267545C.6 | Z. mays |
| miR167 | Auxin Response Factor | 917 | MRT4577_306050C.5 | Z. mays |
| miR167 | Auxin Response Factor | 918 | MRT4577_310720C.4 | Z. mays |
| miR167 | Auxin Response Factor | 919 | MRT4577_339989C.4 | Z. mays |
| miR167 | Auxin Response Factor | 920 | MRT4577_35746C.4 | Z. mays |
| miR167 | Auxin Response Factor | 921 | MRT4577_360403C.2 | Z. mays |
| miR167 | Auxin Response Factor | 922 | MRT4577_377896C.4 | Z. mays |
| miR167 | Auxin Response Factor | 923 | MRT4577_45522C.9 | Z. mays |
| miR167 | Auxin Response Factor | 924 | MRT4577_509023C.3 | Z. mays |
| miR167 | Auxin Response Factor | 925 | MRT4577_521851C.2 | Z. mays |
| miR167 | Auxin Response Factor | 926 | MRT4577_536912C.2 | Z. mays |
| miR167 | Auxin Response Factor | 927 | MRT4577_569979C.1 | Z. mays |
| miR167 | Auxin Response Factor | 928 | MRT4577_650810C.1 | Z. mays |
| miR167 | Auxin Response Factor | 929 | MRT4577_676039C.1 | Z. mays |
| miR167 | Auxin Response Factor | 930 | MRT4577_680014C.1 | Z. mays |
| miR167 | Auxin Response Factor | 931 | MRT4577_681088C.1 | Z. mays |
| miR167 | Auxin Response Factor | 932 | MRT4577_681995C.1 | Z. mays |
| miR167 | Auxin Response Factor | 933 | MRT4577_683953C.1 | Z. mays |
| miR167 | Auxin Response Factor | 934 | MRT4577_684325C.1 | Z. mays |
| miR167 | Auxin Response Factor | 935 | MRT4577_8821C.7 | Z. mays |
| miR168 | Argonaute | 936 | MRT4577_247045C.8 | Z. mays |
| miR168 | Argonaute | 937 | MRT4577_29086C.7 | Z. mays |
| miR168 | Argonaute | 938 | MRT4577_418712C.5 | Z. mays |
| miR168 | Argonaute | 939 | MRT4577_57570C.9 | Z. mays |
| miR168 | Argonaute | 940 | MRT4577_577443C.1 | Z. mays |
| miR169 | CCAAT-binding | 941 | MRT4577_40749C.8 | Z. mays |
| miR169 | CCAAT-binding | 942 | MRT4577_428392C.4 | Z. mays |
| miR169 | CCAAT-binding | 943 | MRT4577_434247C.4 | Z. mays |
| miR169 | CCAAT-binding | 944 | MRT4577_536961C.2 | Z. mays |
| miR169 | CCAAT-binding | 945 | MRT4577_536962C.2 | Z. mays |
| miR169 | CCAAT-binding | 946 | MRT4577_540147C.2 | Z. mays |
| miR169 | CCAAT-binding | 947 | MRT4577_556372C.2 | Z. mays |
| miR169 | CCAAT-binding | 948 | MRT4577_570254C.1 | Z. mays |
| miR169 | CCAAT-binding | 949 | MRT4577_668660C.1 | Z. mays |
| miR169 | CCAAT-binding | 950 | MRT4577_693949C.1 | Z. mays |
| miR169 | CCAAT-binding | 951 | MRT4577_701125C.1 | Z. mays |
| miR170/171 | SCL | 952 | PHE0006551 | Z. mays |
| miR170/171 | SCL | 953 | MRT4577_140896C.6 | Z. mays |
| miR170/171 | SCL | 954 | MRT4577_234039C.6 | Z. mays |
| miR170/171 | SCL | 955 | MRT4577_269667C.5 | Z. mays |
| miR170/171 | SCL | 956 | MRT4577_520619C.2 | Z. mays |
| miR170/171 | SCL | 957 | MRT4577_617401C.1 | Z. mays |
| miR170/171 | SCL | 958 | MRT4577_75777C.8 | Z. mays |
| miR171 | GRAS | 959 | MRT4577_26778C.8 | Z. mays |
| miR171 | GRAS | 960 | MRT4577_30852C.6 | Z. mays |
| miR171 | GRAS | 961 | MRT4577_683754C.1 | Z. mays |
| miR171 | GRAS | 962 | MRT4577_687943C.1 | Z. mays |
| miR171 | Scarecrow | 963 | MRT4577_569322C.1 | Z. mays |
| miR172 | AP2 | 964 | PHE0006602 | Z. mays |
| miR172 | AP2 domain | 965 | MRT4577_12523C.7 | Z. mays |
| miR172 | AP2 domain | 966 | MRT4577_27478C.9 | Z. mays |
| miR172 | AP2 domain | 967 | MRT4577_304712C.4 | Z. mays |
| miR172 | AP2 domain | 968 | MRT4577_307553C.7 | Z. mays |
| miR172 | AP2 domain | 969 | MRT4577_431122C.3 | Z. mays |

TABLE 2-continued

Computationally validated miRNA targets

| miRNA | Gene Function | SEQ ID NO: | Gene ID | Species of origin* |
|---|---|---|---|---|
| miR172 | AP2 domain | 970 | MRT4577_455774C.3 | Z. mays |
| miR172 | AP2 domain | 971 | MRT4577_468762C.3 | Z. mays |
| miR172 | AP2 domain | 972 | MRT4577_548310C.2 | Z. mays |
| miR172 | AP2 domain | 973 | MRT4577_556612C.2 | Z. mays |
| miR172 | AP2 domain | 974 | MRT4577_597136C.1 | Z. mays |
| miR172 | AP2 domain | 975 | MRT4577_669210C.1 | Z. mays |
| miR172 | AP2 domain | 976 | MRT4577_676464C.1 | Z. mays |
| miR172 | AP2 domain | 977 | MRT4577_708079C.1 | Z. mays |
| miR172 | APETALA2 | 978 | MRT4577_49517C.8 | Z. mays |
| miR172 | APETALA2 | 979 | MRT4577_700043C.1 | Z. mays |
| miR172 | Glossy15 | 980 | PHE0000011 | Z. mays |
| miR319 | Cyclin | 981 | PHE0001434 | Z. mays |
| miR319 | PCF | 982 | MRT4577_427906C.4 | Z. mays |
| miR319 | PCF | 983 | MRT4577_480991C.1 | Z. mays |
| miR319 | PCF | 984 | MRT4577_568064C.1 | Z. mays |
| miR319 | PCF | 985 | MRT4577_590917C.1 | Z. mays |
| miR319 | PCF | 986 | MRT4577_679533C.1 | Z. mays |
| miR319 | PCF | 987 | MRT4577_680167C.1 | Z. mays |
| miR319 | TCP family transcription factor | 988 | MRT4577_147719C.7 | Z. mays |
| miR319 | TCP family transcription factor | 989 | MRT4577_221733C.7 | Z. mays |
| miR319 | TCP family transcription factor | 990 | MRT4577_275063C.6 | Z. mays |
| miR319 | TCP family transcription factor | 991 | MRT4577_30525C.6 | Z. mays |
| miR319 | TCP family transcription factor | 992 | MRT4577_340633C.4 | Z. mays |
| miR319 | TCP family transcription factor | 993 | MRT4577_557860C.2 | Z. mays |
| miR319 | TCP family transcription factor | 994 | MRT4577_558102C.2 | Z. mays |
| miR319 | TCP family transcription factor | 995 | MRT4577_568063C.1 | Z. mays |
| miR319 | TCP family transcription factor | 996 | MRT4577_571095C.1 | Z. mays |
| miR319 | TCP family transcription factor | 997 | MRT4577_590269C.1 | Z. mays |
| miR319 | TCP family transcription factor | 998 | MRT4577_686625C.1 | Z. mays |
| miR390 | TAS | 999 | MRT4577_306288C.5 | Z. mays |
| miR390 | TAS | 1000 | MRT4577_325578C.3 | Z. mays |
| miR390 | TAS | 1001 | MRT4577_687438C.1 | Z. mays |
| miR390 | TAS | 1002 | MRT4577_72903C.4 | Z. mays |
| miR393 | F-box | 1003 | PHE0000546 | Z. mays |
| miR393 | F-box | 1004 | PHE0000912 | Z. mays |
| miR393 | Transport inhibitor response | 1005 | MRT4577_39097C.9 | Z. mays |
| miR393 | Transport inhibitor response | 1006 | MRT4577_546333C.2 | Z. mays |
| miR393 | Transport inhibitor response | 1007 | MRT4577_560980C.2 | Z. mays |
| miR393 | Transport inhibitor response | 1008 | MRT4577_656737C.1 | Z. mays |
| miR393 | Transport inhibitor response | 1009 | MRT4577_688815C.1 | Z. mays |
| miR394 | F-box domain | 1010 | MRT4577_56429C.8 | Z. mays |
| miR394 | F-box domain | 1011 | MRT4577_613832C.1 | Z. mays |
| miR395 | AST | 1012 | MRT4577_293072C.7 | Z. mays |
| miR395 | AST | 1013 | MRT4577_57393C.8 | Z. mays |
| miR395 | AST | 1014 | MRT4577_594643C.1 | Z. mays |
| miR395 | AST | 1015 | MRT4577_655078C.1 | Z. mays |
| miR395 | AST | 1016 | MRT4577_681126C.1 | Z. mays |
| miR395 | ATP sulfurylase | 1017 | MRT4577_118322C.5 | Z. mays |
| miR395 | ATP sulfurylase | 1018 | MRT4577_453989C.4 | Z. mays |
| miR395 | sulfate adenylyltransferase | 1019 | MRT4577_386324C.4 | Z. mays |
| miR395 | sulfate adenylyltransferase | 1020 | MRT4577_57434C.9 | Z. mays |
| miR395 | sulfate adenylyltransferase | 1021 | MRT4577_694623C.1 | Z. mays |
| miR395 | sulfate adenylyltransferase | 1022 | MRT4577_709359C.1 | Z. mays |
| miR395 | sulfate transporter | 1023 | MRT4577_644561C.1 | Z. mays |
| miR396 | Growth-regulating factor | 1024 | PHE0000025 | Z. mays |
| miR396 | Growth-regulating factor | 1025 | PHE0000289 | Z. mays |
| miR396 | Growth-regulating factor | 1026 | PHE0001216 | Z. mays |
| miR396 | Growth-regulating factor | 1027 | MRT4577_215581C.4 | Z. mays |
| miR396 | Growth-regulating factor | 1028 | MRT4577_215583C.5 | Z. mays |
| miR396 | Growth-regulating factor | 1029 | MRT4577_232004C.7 | Z. mays |
| miR396 | Growth-regulating factor | 1030 | MRT4577_24924C.7 | Z. mays |
| miR396 | Growth-regulating factor | 1031 | MRT4577_266456C.6 | Z. mays |
| miR396 | Growth-regulating factor | 1032 | MRT4577_278593C.3 | Z. mays |
| miR396 | Growth-regulating factor | 1033 | MRT4577_29961C.8 | Z. mays |
| miR396 | Growth-regulating factor | 1034 | MRT4577_356670C.6 | Z. mays |
| miR396 | Growth-regulating factor | 1035 | MRT4577_359461C.1 | Z. mays |
| miR396 | Growth-regulating factor | 1036 | MRT4577_372672C.5 | Z. mays |
| miR396 | Growth-regulating factor | 1037 | MRT4577_410501C.4 | Z. mays |
| miR396 | Growth-regulating factor | 1038 | MRT4577_432229C.3 | Z. mays |
| miR396 | Growth-regulating factor | 1039 | MRT4577_534804C.2 | Z. mays |
| miR396 | Growth-regulating factor | 1040 | MRT4577_551090C.1 | Z. mays |
| miR396 | Growth-regulating factor | 1041 | MRT4577_563407C.1 | Z. mays |
| miR396 | Growth-regulating factor | 1042 | MRT4577_569284C.1 | Z. mays |
| miR396 | Growth-regulating factor | 1043 | MRT4577_597418C.1 | Z. mays |
| miR396 | Growth-regulating factor | 1044 | MRT4577_618948C.1 | Z. mays |

TABLE 2-continued

Computationally validated miRNA targets

| miRNA | Gene Function | SEQ ID NO: | Gene ID | Species of origin* |
|---|---|---|---|---|
| miR396 | Growth-regulating factor | 1045 | MRT4577_635741C.1 | Z. mays |
| miR397 | Laccase | 1046 | MRT4577_233334C.7 | Z. mays |
| miR397 | Laccase | 1047 | MRT4577_26704C.2 | Z. mays |
| miR397 | Laccase | 1048 | MRT4577_293572C.3 | Z. mays |
| miR397 | Laccase | 1049 | MRT4577_602028C.1 | Z. mays |
| miR398 | cytochrome c oxidase | 1050 | MRT4577_434356C.4 | Z. mays |
| miR398 | cytochrome c oxidase | 1051 | MRT4577_547404C.2 | Z. mays |
| miR399 | Cyclin | 1052 | PHE0002694 | Z. mays |
| miR400 | PPR | 1053 | MRT4577_480700C.2 | Z. mays |
| miR400 | PPR | 1054 | MRT4577_593504C.1 | Z. mays |
| miR408 | blue copper protein | 1055 | MRT4577_325458C.1 | Z. mays |
| miR408 | blue copper protein | 1056 | MRT4577_37590C.9 | Z. mays |
| miR408 | blue copper protein | 1057 | MRT4577_47069C.8 | Z. mays |
| miR408 | blue copper protein | 1058 | MRT4577_528699C.2 | Z. mays |
| miR408 | blue copper protein | 1059 | MRT4577_550892C.1 | Z. mays |
| miR408 | Laccase | 1060 | PHE0003380 | Z. mays |
| miR408 | Laccase | 1061 | MRT4577_245033C.8 | Z. mays |
| miR408 | Laccase | 1062 | MRT4577_380413C.6 | Z. mays |
| miR408 | Laccase | 1063 | MRT4577_388860C.4 | Z. mays |
| miR408 | Laccase | 1064 | MRT4577_461451C.3 | Z. mays |
| miR408 | Laccase | 1065 | MRT4577_625157C.1 | Z. mays |
| miR408 | Laccase | 1066 | MRT4577_629379C.1 | Z. mays |
| miR408 | plantacyanin | 1067 | PHE0000329 | Z. mays |
| miR444 | MADS | 1068 | PHE0013719 | Z. mays |
| miR444 | MADS box | 1069 | PHE0002650 | Z. mays |
| miR444 | MADS box | 1070 | MRT4577_321664C.4 | Z. mays |
| miR444 | MADS-box | 1071 | MRT4577_204116C.4 | Z. mays |
| miR444 | MADS-box | 1072 | MRT4577_537511C.2 | Z. mays |
| miR444 | MADS-box | 1073 | MRT4577_553467C.1 | Z. mays |
| miR444 | MADS-box | 1074 | MRT4577_613242C.1 | Z. mays |
| miR444 | MADS-box | 1075 | MRT4577_695496C.1 | Z. mays |
| miR472 | ATP binding | 1076 | MRT4577_110498C.5 | Z. mays |
| miR472 | ATP binding | 1077 | MRT4577_251486C.3 | Z. mays |
| miR472 | NBS-LRR type disease resistance protein | 1078 | MRT4577_320221C.4 | Z. mays |
| miR475 | PPR | 1079 | MRT4577_110120C.3 | Z. mays |
| miR475 | PPR | 1080 | MRT4577_205728C.3 | Z. mays |
| miR475 | PPR | 1081 | MRT4577_664698C.1 | Z. mays |
| miR477 | GRAS | 1082 | MRT4577_278714C.7 | Z. mays |
| miR477 | GRAS | 1083 | MRT4577_401721C.2 | Z. mays |
| miR477 | GRAS | 1084 | MRT4577_463199C.2 | Z. mays |
| miR477 | GRAS | 1085 | MRT4577_526548C.1 | Z. mays |
| miR477 | GRAS | 1086 | MRT4577_569010C.1 | Z. mays |
| miR482 | disease resistance | 1087 | MRT4577_204880C.4 | Z. mays |
| miR482 | disease resistance | 1088 | MRT4577_285745C.3 | Z. mays |
| miR482 | disease resistance | 1089 | MRT4577_537326C.2 | Z. mays |
| miR482 | disease resistance | 1090 | MRT4577_642390C.1 | Z. mays |
| miR482 | disease resistance | 1091 | MRT4577_647253C.1 | Z. mays |
| miR482 | disease resistance | 1092 | MRT4577_700169C.1 | Z. mays |
| miR776 | IRE | 1093 | MRT4577_475418C.2 | Z. mays |
| miR776 | IRE | 1094 | MRT4577_569446C.1 | Z. mays |
| miR776 | IRE | 1095 | MRT4577_668929C.1 | Z. mays |
| miR827 | SYG1/Pho81/XPR1 | 1096 | MRT4577_565044C.1 | Z. mays |
| miR844 | protein kinase | 1097 | MRT4577_34878C.9 | Z. mays |
| miR844 | protein kinase | 1098 | MRT4577_469768C.2 | Z. mays |
| miR857 | LAC | 1099 | MRT4577_447458C.4 | Z. mays |
| miR858 | MYB | 1100 | MRT4577_230084C.4 | Z. mays |
| miR858 | MYB | 1101 | MRT4577_28298C.7 | Z. mays |
| miR858 | MYB | 1102 | MRT4577_365133C.3 | Z. mays |
| miR858 | MYB | 1103 | MRT4577_691552C.1 | Z. mays |
| miR858 | myb-like | 1104 | MRT4577_237723C.3 | Z. mays |
| miR858 | myb-like DNA-binding | 1105 | MRT4577_204899C.4 | Z. mays |
| miR858 | myb-like DNA-binding | 1106 | MRT4577_229676C.2 | Z. mays |
| miR858 | myb-like DNA-binding | 1107 | MRT4577_303539C.6 | Z. mays |
| miR858 | myb-like DNA-binding | 1108 | MRT4577_330816C.1 | Z. mays |
| miR858 | myb-like DNA-binding | 1109 | MRT4577_340919C.6 | Z. mays |
| miR858 | myb-like DNA-binding | 1110 | MRT4577_549954C.1 | Z. mays |
| miR858 | myb-like DNA-binding | 1111 | MRT4577_585620C.1 | Z. mays |
| miR858 | myb-like DNA-binding | 1112 | MRT4577_665482C.1 | Z. mays |
| miR858 | myb-like DNA-binding | 1113 | MRT4577_704749C.1 | Z. mays |
| miR904 | AGO | 1114 | MRT4577_374929C.6 | Z. mays |

Example 4

This example provides additional embodiments of target genes identified as "validated miRNA targets" (i.e., containing a validated miRNA recognition site) and representative uses of validated miRNA recognition sites, e.g., for the design of artificial sequences useful in making recombinant DNA constructs, including, but not limited to, transgenes with an exogenous miRNA recognition site added, transgenes with a native miRNA recognition site modified or deleted, decoys, cleavage blockers, or translational inhibitors as taught and claimed by Applicants. Recombinant DNA constructs of this invention are useful for modulating expression of such target genes and for making non-natural transgenic plant cells, plant tissues, and plants (especially non-natural transgenic crop plants) having improved yield or other desirable traits.

Table 3 provides a list of miRNAs and miRNA targets containing miRNA recognition sites that were identified in various plants using techniques similar to those described in Example 2. The miRNA targets were identified by gene name, protein domain, function, location, or simply as a gene having a miRNA recognition site; this information is sufficient for designing artificial sequences including miRNA-unresponsive transgenes, cleavage blockers, 5'-modified cleavage blockers, translational inhibitors, and miRNA decoys. Table 3 further provides a list of miRNA precursors (designed to be processed to a native mature miRNA), as well as artificial sequences including miRNA precursors designed to be processed to a synthetic mature miRNA, miRNA decoys, miRNA-unresponsive transgenes, and miRNA cleavage blockers, all of which are especially useful in making recombinant DNA constructs of this invention. One of ordinary skill in the art, informed by the teachings of this application and provided with the nucleotide sequence of a miRNA or a miRNA recognition site in a target gene, would be readily able to devise such artificial sequences. Such a person of ordinary skill would further recognize that knowledge of the target gene itself is not required, merely the sequence of the mature miRNA sequence or of a miRNA precursor that is processed to the mature miRNA—or, alternatively, knowledge of the miRNA recognition site sequence—in combination with the teachings of this application, in order to devise a cleavage blocker (or 5'-modified cleavage blocker) to inhibit the target gene silencing effects of a given miRNA. Table 3 also provides examples of recombinant DNA constructs which, when transgenically expressed in a crop plant (preferably, but not limited to, maize or corn, soybean, canola, cotton, alfalfa, sugarcane, sugar beet, sorghum, and rice), results in improved yield by that crop plant, when compared to the crop plant in which the construct is not expressed. Techniques for making transgenic plants are described under the heading "Making and Using Transgenic Plant Cells and Transgenic Plants". "Improved yield" can be increased intrinsic yield; in other embodiments, improved yield is yield increased under a particular growing condition, such as abiotic or biotic stress conditions (e.g., heat or cold stress, drought stress, or nutrient stress), when compared to a crop lacking expression of the recombinant DNA construct of this invention.

With the above information about miRNA targets, one of ordinary skill in the art is able to make and use various additional embodiments of aspects of this invention, including a recombinant DNA construct transcribable in a plant cell, including a promoter that is functional in the plant cell and operably linked to at least one polynucleotide selected from: (a) DNA encoding a cleavage blocker to prevent or decrease small RNA-mediated cleavage of the transcript of at least one miRNA target identified in Tables 2 or 3; (b) DNA encoding a 5'-modified cleavage blocker to prevent or decrease small RNA-mediated cleavage of the transcript of at least one miRNA target identified in Tables 2 or 3; (c) DNA encoding a translational inhibitor to prevent or decrease small RNA-mediated cleavage of the transcript of at least one miRNA target identified in Tables 2 or 3; (d) DNA encoding a decoy to prevent or decrease small RNA-mediated cleavage of the transcript of at least one miRNA target identified in Tables 2 or 3; (e) DNA encoding a miRNA-unresponsive transgene having a nucleotide sequence derived from the native nucleotide sequence of at least one miRNA target identified in Tables 2 or 3, wherein a miRNA recognition site in the native nucleotide sequence is deleted or otherwise modified to prevent miRNA-mediated cleavage; (f) DNA encoding a miRNA precursor which is processed into a miRNA for suppressing expression of at least one miRNA target identified in Tables 2 or 3; (g) DNA encoding double-stranded RNA which is processed into siRNAs for suppressing expression of at least one miRNA target identified in Tables 2 or 3; and (h) DNA encoding a ta-siRNA which is processed into siRNAs for suppressing expression of at least one miRNA target identified in Tables 2 or 3. Specifically claimed are embodiments wherein the recombinant DNA construct is stably integrated into a plastid or a chromosome of the plant cell. Also specifically claimed are methods to improve yield in a plant, wherein the recombinant DNA construct is transgenically expressed in a crop plant (preferably, but not limited to, maize or corn, soybean, canola, cotton, alfalfa, sugarcane, sugar beet, sorghum, and rice), resulting in improved yield by that crop plant, when compared to the crop plant in which the construct is not expressed.

Embodiments within the scope of this invention include a recombinant DNA construct transcribable in a plant cell, including a promoter that is functional in the plant cell and operably linked to at least one polynucleotide selected from: (a) DNA encoding a cleavage blocker to prevent or decrease small RNA-mediated cleavage of the transcript of at least one miRNA target; (b) DNA encoding a 5'-modified cleavage blocker to prevent or decrease small RNA-mediated cleavage of the transcript of at least one miRNA target; (c) DNA encoding a translational inhibitor to prevent or decrease small RNA-mediated cleavage of the transcript of at least one miRNA target; (d) DNA encoding a decoy to prevent or decrease small RNA-mediated cleavage of the transcript of at least one miRNA target; (e) DNA encoding a miRNA-unresponsive transgene having a nucleotide sequence derived from the native nucleotide sequence of at least one miRNA target, wherein a miRNA recognition site in the native nucleotide sequence is deleted or otherwise modified to prevent miRNA-mediated cleavage; (f) DNA encoding a miRNA precursor which is processed into a miRNA for suppressing expression of at least one miRNA target; (g) DNA encoding double-stranded RNA which is processed into siRNAs for suppressing expression of at least one miRNA target; and (h) DNA encoding a ta-siRNA which is processed into siRNAs for suppressing expression of at least one miRNA target— wherein the at least one miRNA target is at least one selected from the group consisting of a miR156 target, a miR160 target, a miR164 target, a miR166 target, a miR167 target, a miR169 target, a miR171 target, a miR172 target, a miR319 target, miR395 target, a miR396 target, a a miR398 target, a miR399 target, a miR408 target, a miR444 target, a miR528 target, a miR167g target, a miR169g target, COP1 (constitutive photomorphogenesis1), GA2ox (gibberellic acid 2 oxidase), GA20ox (gibberellic acid 20 oxidase), HB2 (homeobox 2), HB2-4 (homeobox 2 and homeobox 4), HB4

(homeobox 4), LG1 (liguleless1), SPX (SYG1, PHO81 and XPR1 domain; PFAM entry PF03105 at www(dot)sanger(dot)ac(dot)uk), VIM1a (variant in methlylation 1a), DHS1 (deoxyhypusine synthase), DHS2 (deoxyhypusine synthase), DHS3 (deoxyhypusine synthase), DHS4 (deoxyhypusine synthase), DHS5 (deoxyhypusine synthase), DHS6 (deoxyhypusine synthase), DHS7 (deoxyhypusine synthase), DHS8 (deoxyhypusine synthase), CRF (corn RING finger; RNF169), G1543a (maize orthologue of *Arabidopsis thaliana* homeobox 17), G1543b (maize orthologue of *Arabidopsis thaliana* homeobox 17), GS3 (grain size 3), and GW2 (grain weight 2). Particular embodiments that are specifically claimed by this invention include a recombinant DNA construct transcribable in a plant cell, including a promoter that is functional in the plant cell and operably linked to at least one polynucleotide selected from the group consisting of DNA encoding a nucleotide sequence selected from SEQ ID NOs: 1120, 1121, 1122, 1248, 1257, 1313, 1314, 1364, 1387, 1478, 1489, 1490, 1491, 1492, 1493, 1585, 1597, 1598, 1599, 1713, 1752, 1753, 1801, 1802, 1820, 1927, 1929, 1931, 1971, 2006, 2007, 2008, 2010, 2012, 2014, 2016, 2018, 2022, 2023, 2025, 2027, 2029, 2031, 2033, 2035, 2037, 2039, 2041, 2043, 2045, 2047, 2049, 2051, 2053, 2055, 2056, 2057, 2059, 2060, 2061, and 2063; also specifically claimed are embodiments wherein the recombinant DNA construct is stably integrated into a plastid or a chromosome of the plant cell.

Further embodiments are methods to improve yield in a plant, wherein a recombinant DNA construct transcribable in a plant cell, including a promoter that is functional in the plant cell and operably linked to at least one polynucleotide selected from: (a) DNA encoding a cleavage blocker to prevent or decrease small RNA-mediated cleavage of the transcript of at least one miRNA target; (b) DNA encoding a 5'-modified cleavage blocker to prevent or decrease small RNA-mediated cleavage of the transcript of at least one miRNA target; (c) DNA encoding a translational inhibitor to prevent or decrease small RNA-mediated cleavage of the transcript of at least one miRNA target; (d) DNA encoding a decoy to prevent or decrease small RNA-mediated cleavage of the transcript of at least one miRNA target; (e) DNA encoding a miRNA-unresponsive transgene having a nucleotide sequence derived from the native nucleotide sequence of at least one miRNA target, wherein a miRNA recognition site in the native nucleotide sequence is deleted or otherwise modified to prevent miRNA-mediated cleavage; (f) DNA encoding a miRNA precursor which is processed into a miRNA for suppressing expression of at least one miRNA target; (g) DNA encoding double-stranded RNA which is processed into siRNAs for suppressing expression of at least one miRNA target; and (h) DNA encoding a ta-siRNA which is processed into siRNAs for suppressing expression of at least one miRNA target—wherein the at least one miRNA target is at least one selected from the group consisting of a miR156 target, a miR160 target, a miR164 target, a miR166 target, a miR167 target, a miR169 target, a miR171 target, a miR172 target, a miR319 target, miR395 target, a miR396 target, a a miR398 target, a miR399 target, a miR408 target, a miR444 target, a miR528 target, a miR167g target, a miR169g target, COP1 (constitutive photomorphogenesis1), GA2ox (gibberellic acid 2 oxidase), GA20ox (gibberellic acid 20 oxidase), HB2 (homeobox 2), HB2-4 (homeobox 2 and homeobox 4), HB4 (homeobox 4), LG1 (liguleless1), SPX (SYG1, PHO81 and XPR1 domain; PFAM entry PF03105 at www(dot)sanger(dot)ac(dot)uk), VIM1a (variant in methlylation 1a), DHS1 (deoxyhypusine synthase), DHS2 (deoxyhypusine synthase), DHS3 (deoxyhypusine synthase), DHS4 (deoxyhypusine synthase), DHS5 (deoxyhypusine synthase), DHS6 (deoxyhypusine synthase), DHS7 (deoxyhypusine synthase), DHS8 (deoxyhypusine synthase), CRF (corn RING finger; RNF169), G1543a (maize orthologue of *Arabidopsis thaliana* homeobox 17), G1543b (maize orthologue of *Arabidopsis thaliana* homeobox 17), GS3 (grain size 3), and GW2 (grain weight 2)—is transgenically expressed in a crop plant (preferably, but not limited to, maize or corn, soybean, canola, cotton, alfalfa, sugarcane, sugar beet, sorghum, and rice), resulting in improved yield by that crop plant, when compared to the crop plant in which the construct is not expressed. Specifically claimed are methods to improve yield in a plant, wherein a recombinant DNA construct transcribable in a plant cell, including a promoter that is functional in the plant cell and operably linked to at least one polynucleotide selected from the group consisting of DNA encoding a nucleotide sequence selected from SEQ ID NOs: 1120, 1121, 1122, 1248, 1257, 1313, 1314, 1364, 1387, 1478, 1489, 1490, 1491, 1492, 1493, 1585, 1597, 1598, 1599, 1713, 1752, 1753, 1801, 1802, 1820, 1927, 1929, 1931, 1971, 2006, 2007, 2008, 2010, 2012, 2014, 2016, 2018, 2022, 2023, 2025, 2027, 2029, 2031, 2033, 2035, 2037, 2039, 2041, 2043, 2045, 2047, 2049, 2051, 2053, 2055, 2056, 2057, 2059, 2060, 2061, and 2063 is transgenically expressed in a crop plant (preferably, but not limited to, maize or corn, soybean, canola, cotton, alfalfa, sugarcane, sugar beet, sorghum, and rice), resulting in improved yield by that crop plant, when compared to the crop plant in which the construct is not expressed.

Additional aspects of this invention include a non-natural transgenic plant cell including a stably integrated recombinant DNA construct transcribable in the non-natural transgenic plant cell, wherein the recombinant DNA construct includes a promoter functional in the non-natural transgenic plant cell and operably linked to at least one polynucleotide selected from DNA encoding at least one miRNA target identified in Tables 2 or 3; the recombinant DNA construct can be stably integrated into a plastid, a chromosome, or the genome of the plant cell. Embodiments include a non-natural transgenic plant cell including a stably integrated recombinant DNA construct transcribable in the non-natural transgenic plant cell, wherein the recombinant DNA construct includes a promoter functional in the non-natural transgenic plant cell and operably linked to at least one polynucleotide including a DNA sequence selected from SEQ ID NOS: 15-2064.

TABLE 3

| Construct type | Name | SEQ ID NO: | Gene ID | Nucleotide Position | Source Organism | Rationale for plant transformation* |
|---|---|---|---|---|---|---|
| miRNA | miR156 | 1115 | | | Zea mays | |
| miRNA | miR156 | 1116 | | | Zea mays | |
| miR156 target | Squamosa Promoter Binding Protein | 1117 | | | Zea mays | |
| miR156 target | Squamosa Promoter Binding Protein | 1118 | | | Zea mays | |

TABLE 3-continued

| Construct type | Name | SEQ ID NO: | Gene ID | Nucleotide Position | Source Organism | Rationale for plant transformation* |
|---|---|---|---|---|---|---|
| miR156 target | Squamosa Promoter Binding Protein | 1119 | | | Zea mays | |
| Decoy (artificial sequence) | miR156 decoy | 1120 | | | Artificial sequence | Improved yield* |
| Decoy (artificial sequence) | miR156 decoy | 1121 | | | Artificial sequence | Improved yield* |
| miRNA-unresponsive | Squamosa Promoter Binding Protein (miR156-unresponsive) | 1122 | | | Artificial sequence | Improved yield* |
| miR156 target | Squamosa Promoter Binding-domain protein | 1123 | MRT4577_564644C.1 | 478-497 | Zea mays | |
| miR156 target | Squamosa Promoter Binding-domain protein | 1124 | MRT4577_23629C.7 | 1001-1020 | Zea mays | |
| miR156 target | Squamosa Promoter Binding-domain protein | 1125 | MRT4577_188360C.6 | 1571-1590 | Zea mays | |
| miR156 target | Squamosa Promoter Binding-domain protein | 1126 | MRT4577_205098C.7 | 1658-1677 | Zea mays | |
| miR156 target | Squamosa Promoter Binding-domain protein | 1127 | MRT4577_565057C.1 | 980-999 | Zea mays | |
| miR156 target | Squamosa Promoter Binding-domain protein | 1128 | MRT4577_137984C.6 | 2097-2116 | Zea mays | |
| miR156 target | Squamosa Promoter Binding-domain protein | 1129 | MRT4577_532824C.3 | 1136-1155 | Zea mays | |
| miR156 target | Squamosa Promoter Binding-domain protein | 1130 | MRT4577_122478C.6 | 767-786 | Zea mays | |
| miR156 target | Squamosa Promoter Binding-domain protein | 1131 | MRT4577_31704C.9 | 1125-1144 | Zea mays | |
| miR156 target | Squamosa Promoter Binding-domain protein | 1132 | MRT4577_26483C.7 | 1503-1522 | Zea mays | |
| miR156 target | Squamosa Promoter Binding-domain protein | 1133 | MRT4577_295538C.7 | 1433-1452 | Zea mays | |
| miR156 target | Squamosa Promoter Binding-domain protein | 1134 | MRT4577_644419C.1 | 962-981 | Zea mays | |
| miR156 target | Squamosa Promoter Binding-domain protein | 1135 | MRT4577_619443C.1 | 914-933 | Zea mays | |
| miR156 target | Squamosa Promoter Binding-domain protein | 1136 | MRT4577_341149C.6 | 1807-1826 | Zea mays | |
| miR156 target | Squamosa Promoter Binding-domain protein | 1137 | MRT4577_78773C.8 | 1202-1221 | Zea mays | |
| miR156 target | Squamosa Promoter Binding-domain protein | 1138 | MRT4577_42534C.9 | 1935-1954 | Zea mays | |
| miR156 target | Squamosa Promoter Binding-domain protein | 1139 | MRT4577_270892C.4 | 978-997 | Zea mays | |
| miR156 target | Squamosa Promoter Binding-domain protein | 1140 | MRT4577_571545C.1 | 623-642 | Zea mays | |
| miR156 target | Squamosa Promoter Binding-domain protein | 1141 | MRT4577_181019C.5 | 788-807 | Zea mays | |
| miR156 target | Squamosa Promoter Binding-domain protein | 1142 | MRT4577_537670C.2 | 575-594 | Zea mays | |
| miR156 target | Squamosa Promoter Binding-domain protein | 1143 | MRT4577_535297C.2 | 1840-1859 | Zea mays | |
| miR156 target | Squamosa Promoter Binding-domain protein | 1144 | MRT4577_334372C.5 | 477-496 | Zea mays | |

TABLE 3-continued

| Construct type | Name | SEQ ID NO: | Gene ID | Nucleotide Position | Source Organism | Rationale for plant transformation* |
|---|---|---|---|---|---|---|
| miR156 target | Squamosa Promoter Binding-domain protein | 1145 | MRT4577__568647C.1 | 1004-1023 | *Zea mays* | |
| miR156 target | Squamosa Promoter Binding-domain protein | 1146 | MRT4577__383301C.4 | 896-915 | *Zea mays* | |
| miR156 target | Squamosa Promoter Binding-domain protein | 1147 | MRT4577__427964C.4 | 991-1010 | *Zea mays* | |
| miR156 target | Squamosa Promoter Binding-domain protein | 1148 | MRT4577__240798C.6 | 769-788 | *Zea mays* | |
| miR156 target | Squamosa Promoter Binding-domain protein | 1149 | MRT4577__38044C.8 | 951-970 | *Zea mays* | |
| miR156 target | Squamosa Promoter Binding-domain protein | 1150 | MRT4577__461098C.3 | 469-488 | *Zea mays* | |
| miR156 target | Squamosa Promoter Binding-domain protein | 1151 | MRT4577__333683C.4 | 643-662 | *Zea mays* | |
| miR156 target | Squamosa Promoter Binding-domain protein | 1152 | MRT4577__396357C.4 | 647-666 | *Zea mays* | |
| miR156 target | Squamosa Promoter Binding-domain protein | 1153 | MRT3635__15393C.1 | 98-117 | *Gossypium hirsutum* | |
| miR156 target | Squamosa Promoter Binding-domain protein | 1154 | MRT3635__15791C.2 | 990-1009 | *Gossypium hirsutum* | |
| miR156 target | miR156 target | 1155 | MRT3635__23851C.2 | 233-252 | *Gossypium hirsutum* | |
| miR156 target | Squamosa Promoter Binding-domain protein | 1156 | MRT3635__28051C.1 | 213-232 | *Gossypium hirsutum* | |
| miR156 target | Squamosa Promoter Binding-domain protein | 1157 | MRT3635__30369C.2 | 1511-1530 | *Gossypium hirsutum* | |
| miR156 target | Squamosa Promoter Binding-domain protein | 1158 | MRT3635__30868C.2 | 652-671 | *Gossypium hirsutum* | |
| miR156 target | Squamosa Promoter Binding-domain protein | 1159 | MRT3635__36657C.2 | 555-574 | *Gossypium hirsutum* | |
| miR156 target | Squamosa Promoter Binding-domain protein | 1160 | MRT3635__48230C.2 | 857-876 | *Gossypium hirsutum* | |
| miR156 target | Squamosa Promoter Binding-domain protein | 1161 | MRT3635__54380C.2 | 21-40 | *Gossypium hirsutum* | |
| miR156 target | Squamosa Promoter Binding-domain protein | 1162 | MRT3635__59825C.1 | 50-69 | *Gossypium hirsutum* | |
| miR156 target | Squamosa Promoter Binding-domain protein | 1163 | MRT3635__65765C.1 | 709-728 | *Gossypium hirsutum* | |
| miR156 target | miR156 target | 1164 | MRT3635__69088C.1 | 1238-1257 | *Gossypium hirsutum* | |
| miR156 target | Squamosa Promoter Binding-domain protein | 1165 | MRT3635__69159C.1 | 892-911 | *Gossypium hirsutum* | |
| miR156 target | miR156 target | 1166 | MRT3635__71102C.1 | 294-313 | *Gossypium hirsutum* | |
| miR156 target | Squamosa Promoter Binding-domain protein | 1167 | MRT3635__72531C.1 | 612-631 | *Gossypium hirsutum* | |
| miR156 target | Squamosa Promoter Binding-domain protein | 1168 | MRT3702__110108C.4 | 1253-1272 | *Arabidopsis thaliana* | |
| miR156 target | Squamosa Promoter Binding-domain protein | 1169 | MRT3702__113039C.2 | 757-776 | *Arabidopsis thaliana* | |
| miR156 target | Squamosa Promoter Binding-domain protein | 1170 | MRT3702__115945C.3 | 2609-2628 | *Arabidopsis thaliana* | |

TABLE 3-continued

| Construct type | Name | SEQ ID NO: | Gene ID | Nucleotide Position | Source Organism | Rationale for plant transformation* |
|---|---|---|---|---|---|---|
| miR156 target | Squamosa Promoter Binding-domain protein | 1171 | MRT3702__11947C.6 | 680-699 | *Arabidopsis thaliana* | |
| miR156 target | Squamosa Promoter Binding-domain protein | 1172 | MRT3702__120785C.3 | 1157-1176 | *Arabidopsis thaliana* | |
| miR156 target | Squamosa Promoter Binding-domain protein | 1173 | MRT3702__141151C.3 | 1073-1092 | *Arabidopsis thaliana* | |
| miR156 target | Squamosa Promoter Binding-domain protein | 1174 | MRT3702__141152C.2 | 1172-1191 | *Arabidopsis thaliana* | |
| miR156 target | miR156 target | 1175 | MRT3702__147696C.3 | 1186-1205 | *Arabidopsis thaliana* | |
| miR156 target | Squamosa Promoter Binding-domain protein | 1176 | MRT3702__147811C.3 | 1446-1465 | *Arabidopsis thaliana* | |
| miR156 target | Squamosa Promoter Binding-domain protein | 1177 | MRT3702__148347C.1 | 1118-1137 | *Arabidopsis thaliana* | |
| miR156 target | Squamosa Promoter Binding-domain protein | 1178 | MRT3702__148348C.3 | 1121-1140 | *Arabidopsis thaliana* | |
| miR156 target | Squamosa Promoter Binding-domain protein | 1179 | MRT3702__15197C.5 | 785-804 | *Arabidopsis thaliana* | |
| miR156 target | Squamosa Promoter Binding-domain protein | 1180 | MRT3702__177137C.1 | 2477-2496 | *Arabidopsis thaliana* | |
| miR156 target | Squamosa Promoter Binding-domain protein | 1181 | MRT3702__179579C.1 | 1149-1168 | *Arabidopsis thaliana* | |
| miR156 target | Squamosa Promoter Binding-domain protein | 1182 | MRT3702__23035C.6 | 1358-1377 | *Arabidopsis thaliana* | |
| miR156 target | Squamosa Promoter Binding-domain protein | 1183 | MRT3702__23765C.7 | 1036-1055 | *Arabidopsis thaliana* | |
| miR156 target | Squamosa Promoter Binding-domain protein | 1184 | MRT3702__4036C.6 | 804-823 | *Arabidopsis thaliana* | |
| miR156 target | Squamosa Promoter Binding-domain protein | 1185 | MRT3702__5396C.6 | 1297-1316 | *Arabidopsis thaliana* | |
| miR156 target | Squamosa Promoter Binding-domain protein | 1186 | MRT3702__9141C.7 | 829-848 | *Arabidopsis thaliana* | |
| miR156 target | Squamosa Promoter Binding-domain protein | 1187 | MRT3702__94277C.3 | 781-800 | *Arabidopsis thaliana* | |
| miR156 target | Squamosa Promoter Binding-domain protein | 1188 | MRT3702__9951C.4 | 781-800 | *Arabidopsis thaliana* | |
| miR156 target | miR156 target | 1189 | MRT3708__10628C.4 | 459-478 | *Brassica napus* | |
| miR156 target | Squamosa Promoter Binding-domain protein | 1190 | MRT3708__22559C.1 | 330-349 | *Brassica napus* | |
| miR156 target | Squamosa Promoter Binding-domain protein | 1191 | MRT3708__53675C.1 | 290-309 | *Brassica napus* | |
| miR156 target | miR156 target | 1192 | MRT3708__58630C.1 | 407-426 | *Brassica napus* | |
| miR156 target | miR156 target | 1193 | MRT3847__14683C.5 | 1677-1696 | *Glycine max* | |
| miR156 target | miR156 target | 1194 | MRT3847__167543C.1 | 486-505 | *Glycine max* | |
| miR156 target | Squamosa Promoter Binding-domain protein | 1195 | MRT3847__197471C.3 | 295-314 | *Glycine max* | |
| miR156 target | miR156 target | 1196 | MRT3847__206274C.4 | 117-136 | *Glycine max* | |
| miR156 target | Squamosa Promoter Binding-domain protein | 1197 | MRT3847__207934C.2 | 547-566 | *Glycine max* | |
| miR156 target | miR156 target | 1198 | MRT3847__213855C.7 | 701-720 | *Glycine max* | |
| miR156 target | Squamosa Promoter Binding-domain protein | 1199 | MRT3847__217782C.3 | 851-870 | *Glycine max* | |

TABLE 3-continued

| Construct type | Name | SEQ ID NO: | Gene ID | Nucleotide Position | Source Organism | Rationale for plant transformation* |
|---|---|---|---|---|---|---|
| miR156 target | Squamosa Promoter Binding-domain protein | 1200 | MRT3847__218322C.4 | 109-128 | Glycine max | |
| miR156 target | Squamosa Promoter Binding-domain protein | 1201 | MRT3847__235081C.4 | 1980-1999 | Glycine max | |
| miR156 target | miR156 target | 1202 | MRT3847__235082C.6 | 915-934 | Glycine max | |
| miR156 target | miR156 target | 1203 | MRT3847__237444C.4 | 582-601 | Glycine max | |
| miR156 target | miR156 target | 1204 | MRT3847__252038C.4 | 515-534 | Glycine max | |
| miR156 target | miR156 target | 1205 | MRT3847__268305C.4 | 396-415 | Glycine max | |
| miR156 target | miR156 target | 1206 | MRT3847__289291C.3 | 961-980 | Glycine max | |
| miR156 target | Squamosa Promoter Binding-domain protein | 1207 | MRT3847__329752C.1 | 933-952 | Glycine max | |
| miR156 target | miR156 target | 1208 | MRT3847__334134C.1 | 1239-1258 | Glycine max | |
| miR156 target | miR156 target | 1209 | MRT3847__335568C.1 | 1747-1766 | Glycine max | |
| miR156 target | miR156 target | 1210 | MRT3847__338602C.1 | 1070-1089 | Glycine max | |
| miR156 target | miR156 target | 1211 | MRT3847__341315C.1 | 47-66 | Glycine max | |
| miR156 target | miR156 target | 1212 | MRT3847__341402C.1 | 978-997 | Glycine max | |
| miR156 target | miR156 target | 1213 | MRT3847__350831C.1 | 1280-1299 | Glycine max | |
| miR156 target | Squamosa Promoter Binding-domain protein | 1214 | MRT3880__19943C.1 | 633-652 | Medicago truncatula | |
| miR156 target | miR156 target | 1215 | MRT3880__49046C.1 | 98-117 | Medicago truncatula | |
| miR156 target | Squamosa Promoter Binding-domain protein | 1216 | MRT3880__54023C.1 | 527-546 | Medicago truncatula | |
| miR156 target | Squamosa Promoter Binding-domain protein | 1217 | MRT3880__59834C.1 | 726-745 | Medicago truncatula | |
| miR156 target | Squamosa Promoter Binding-domain protein | 1218 | MRT3880__62151C.1 | 1070-1089 | Medicago truncatula | |
| miR156 target | Squamosa Promoter Binding-domain protein | 1219 | MRT4513__19757C.1 | 529-548 | Hordeum vulgare | |
| miR156 target | Squamosa Promoter Binding-domain protein | 1220 | MRT4513__41849C.1 | 439-458 | Hordeum vulgare | |
| miR156 target | Squamosa Promoter Binding-domain protein | 1221 | MRT4513__4449C.1 | 221-240 | Hordeum vulgare | |
| miR156 target | Squamosa Promoter Binding-domain protein | 1222 | MRT4513__52153C.1 | 523-542 | Hordeum vulgare | |
| miR156 target | miR156 target | 1223 | MRT4530__11398C.3 | 696-715 | Oryza sativa | |
| miR156 target | Squamosa Promoter Binding-domain protein | 1224 | MRT4530__118092C.3 | 821-840 | Oryza sativa | |
| miR156 target | Squamosa Promoter Binding-domain protein | 1225 | MRT4530__135991C.4 | 710-729 | Oryza sativa | |
| miR156 target | Squamosa Promoter Binding-domain protein | 1226 | MRT4530__142142C.4 | 1074-1093 | Oryza sativa | |
| miR156 target | Squamosa Promoter Binding-domain protein | 1227 | MRT4530__195506C.2 | 981-1000 | Oryza sativa | |
| miR156 target | Squamosa Promoter Binding-domain protein | 1228 | MRT4530__199837C.4 | 2401-2420 | Oryza sativa | |
| miR156 target | miR156 target | 1229 | MRT4530__219862C.2 | 146-165 | Oryza sativa | |
| miR156 target | Squamosa Promoter Binding-domain protein | 1230 | MRT4530__220364C.2 | 1764-1783 | Oryza sativa | |
| miR156 target | Squamosa Promoter Binding-domain protein | 1231 | MRT4530__230201C.3 | 265-284 | Oryza sativa | |
| miR156 target | miR156 target | 1232 | MRT4530__230404C.3 | 2222-2241 | Oryza sativa | |
| miR156 target | Squamosa Promoter Binding-domain protein | 1233 | MRT4530__236277C.1 | 728-747 | Oryza sativa | |

TABLE 3-continued

| Construct type | Name | SEQ ID NO: | Gene ID | Nucleotide Position | Source Organism | Rationale for plant transformation* |
|---|---|---|---|---|---|---|
| miR156 target | Squamosa Promoter Binding-domain protein | 1234 | MRT4530__257640C.1 | 956-975 | Oryza sativa | |
| miR156 target | Squamosa Promoter Binding-domain protein | 1235 | MRT4530__44605C.5 | 1148-1167 | Oryza sativa | |
| miR156 target | Squamosa Promoter Binding-domain protein | 1236 | MRT4530__53217C.5 | 858-877 | Oryza sativa | |
| miR156 target | Squamosa Promoter Binding-domain protein | 1237 | MRT4530__6964C.4 | 2113-2132 | Oryza sativa | |
| miR156 target | miR156 target | 1238 | MRT4530__95203C.4 | 994-1013 | Oryza sativa | |
| miR156 target | Squamosa Promoter Binding-domain protein | 1239 | MRT4558__12680C.1 | 78-97 | Sorghum bicolor | |
| miR156 target | Squamosa Promoter Binding-domain protein | 1240 | MRT4558__27285C.1 | 130-149 | Sorghum bicolor | |
| miR156 target | Squamosa Promoter Binding-domain protein | 1241 | MRT4558__6587C.1 | 516-535 | Sorghum bicolor | |
| miR156 target | Squamosa Promoter Binding-domain protein | 1242 | MRT4558__8644C.2 | 866-885 | Sorghum bicolor | |
| miR156 target | miR156 target | 1243 | MRT4565__169464C.2 | 296-315 | Triticum aestivum | |
| miR156 target | Squamosa Promoter Binding-domain protein | 1244 | MRT4565__212647C.1 | 523-542 | Triticum aestivum | |
| miR156 target | Squamosa Promoter Binding-domain protein | 1245 | MRT4565__239085C.1 | 1565-1584 | Triticum aestivum | |
| miR156 target | Squamosa Promoter Binding-domain protein | 1246 | MRT4565__259386C.1 | 339-358 | Triticum aestivum | |
| miR156 target | Squamosa Promoter Binding-domain protein | 1247 | MRT4565__272025C.1 | 954-973 | Triticum aestivum | |
| Decoy (artificial sequence) | miR160 decoy | 1248 | | | Artificial sequence | Improved yield* |
| miR160 target | Auxin Response Factor 10-like protein | 1249 | MRT4577__429671C.3 | 1429-1449 | Zea mays | |
| miR160 target | Auxin Response Factor 10-like protein | 1250 | MRT4577__400043C.4 | 1894-1914 | Zea mays | |
| miR160 target | Auxin Response Factor 10-like protein | 1251 | MRT4577__385317C.3 | 863-883 | Zea mays | |
| miR160 target | Auxin Response Factor 10-like protein | 1252 | MRT4577__41620C.6 | 756-776 | Zea mays | |
| miR160 target | Auxin Response Factor 10-like protein | 1253 | MRT4577__258637C.2 | 1353-1373 | Zea mays | |
| miR160 target | Auxin Response Factor 10-like protein | 1254 | MRT4577__448022C.1 | 421-442 | Zea mays | |
| miRNA | miR164 | 1255 | | | Zea mays | |
| miR164 target | NAC1; No Apical Meristem, ATAF, Cup Shaped Cotyledon (NAC) domain protein | 1256 | | | Zea mays | |
| miRNA-unresponsive | NAC1 (miR164-unresponsive) | 1257 | | | Artificial sequence | Improved yield* |
| miR164 target | miR164 target | 1258 | MRT3635__6393C.2 | 135-155 | Gossypium hirsutum | |
| miR164 target | miR164 target | 1259 | MRT3635__64345C.1 | 925-945 | Gossypium hirsutum | |
| miR164 target | No Apical Meristem, ATAF, Cup Shaped Cotyledon (NAC) domain protein | 1260 | MRT3702__105151C.5 | 843-863 | Arabidopsis thaliana | |
| miR164 target | CUC1; No Apical Meristem, ATAF, Cup Shaped Cotyledon (NAC) domain protein | 1261 | MRT3702__11937C.6 | 651-671 | Arabidopsis thaliana | |
| miR164 target | NAC1; No Apical Meristem, ATAF, Cup | 1262 | MRT3702__180541C.1 | 762-782 | Arabidopsis thaliana | |

TABLE 3-continued

| Construct type | Name | SEQ ID NO: | Gene ID | Nucleotide Position | Source Organism | Rationale for plant transformation* |
|---|---|---|---|---|---|---|
| miR164 target | Shaped Cotyledon (NAC) domain protein NAC1; No Apical Meristem, ATAF, Cup Shaped Cotyledon (NAC) domain protein | 1263 | MRT3702__180670C.1 | 785-805 | Arabidopsis thaliana | |
| miR164 target | No Apical Meristem, ATAF, Cup Shaped Cotyledon (NAC) domain protein | 1264 | MRT3702__20256C.5 | 651-671 | Arabidopsis thaliana | |
| miR164 target | No Apical Meristem, ATAF, Cup Shaped Cotyledon (NAC) domain protein | 1265 | MRT3702__22669C.4 | 765-785 | Arabidopsis thaliana | |
| miR164 target | CUC2; No Apical Meristem, ATAF, Cup Shaped Cotyledon (NAC) domain protein | 1266 | MRT3702__24103C.6 | 856-876 | Arabidopsis thaliana | |
| miR164 target | No Apical Meristem, ATAF, Cup Shaped Cotyledon (NAC) domain protein | 1267 | MRT3702__24851C.6 | 809-829 | Arabidopsis thaliana | |
| miR164 target | No Apical Meristem, ATAF, Cup Shaped Cotyledon (NAC) domain protein | 1268 | MRT3708__39966C.1 | 192-212 | Brassica napus | |
| miR164 target | No Apical Meristem, ATAF, Cup Shaped Cotyledon (NAC) domain protein | 1269 | MRT3708__51022C.1 | 803-823 | Brassica napus | |
| miR164 target | No Apical Meristem, ATAF, Cup Shaped Cotyledon (NAC) domain protein | 1270 | MRT3712__8777C.1 | 316-336 | Brassica oleracea | |
| miR164 target | No Apical Meristem, ATAF, Cup Shaped Cotyledon (NAC) domain protein | 1271 | MRT3847__244824C.2 | 290-310 | Glycine max | |
| miR164 target | No Apical Meristem, ATAF, Cup Shaped Cotyledon (NAC) domain protein | 1272 | MRT3847__259513C.2 | 719-739 | Glycine max | |
| miR164 target | No Apical Meristem, ATAF, Cup Shaped Cotyledon (NAC) domain protein | 1273 | MRT3847__270117C.3 | 784-804 | Glycine max | |
| miR164 target | No Apical Meristem, ATAF, Cup Shaped Cotyledon (NAC) domain protein | 1274 | MRT3847__46332C.2 | 714-734 | Glycine max | |
| miR164 target | No Apical Meristem, ATAF, Cup Shaped Cotyledon (NAC) domain protein | 1275 | MRT3847__46333C.6 | 731-751 | Glycine max | |
| miR164 target | No Apical Meristem, ATAF, Cup Shaped Cotyledon (NAC) domain protein | 1276 | MRT3847__48464C.4 | 1140-1160 | Glycine max | |
| miR164 target | No Apical Meristem, ATAF, Cup Shaped Cotyledon (NAC) domain protein | 1277 | MRT3847__48465C.6 | 777-797 | Glycine max | |
| miR164 target | No Apical Meristem, ATAF, Cup Shaped Cotyledon (NAC) domain protein | 1278 | MRT3880__18003C.2 | 705-725 | Medicago truncatula | |
| miR164 target | miR164 target | 1279 | MRT3880__33685C.1 | 278-298 | Medicago truncatula | |
| miR164 target | No Apical Meristem, ATAF, Cup Shaped Cotyledon (NAC) domain protein | 1280 | MRT3880__44619C.1 | 781-801 | Medicago truncatula | |
| miR164 target | No Apical Meristem, ATAF, Cup Shaped Cotyledon (NAC) domain protein | 1281 | MRT4513__26199C.1 | 809-829 | Hordeum vulgare | |

TABLE 3-continued

| Construct type | Name | SEQ ID NO: | Gene ID | Nucleotide Position | Source Organism | Rationale for plant transformation* |
|---|---|---|---|---|---|---|
| miR164 target | No Apical Meristem, ATAF, Cup Shaped Cotyledon (NAC) domain protein | 1282 | MRT4513__37185C.1 | 17-37 | Hordeum vulgare | |
| miR164 target | Salicylic acid-induced protein 19 | 1283 | MRT4513__4722C.1 | 251-271 | Hordeum vulgare | |
| miR164 target | No Apical Meristem, ATAF, Cup Shaped Cotyledon (NAC) domain protein | 1284 | MRT4513__7890C.1 | 687-707 | Hordeum vulgare | |
| miR164 target | No Apical Meristem, ATAF, Cup Shaped Cotyledon (NAC) domain protein | 1285 | MRT4530__141528C.5 | 890-910 | Oryza sativa | |
| miR164 target | No Apical Meristem, ATAF, Cup Shaped Cotyledon (NAC) domain protein | 1286 | MRT4530__147737C.4 | 912-932 | Oryza sativa | |
| miR164 target | No Apical Meristem, ATAF, Cup Shaped Cotyledon (NAC) domain protein | 1287 | MRT4530__157393C.3 | 923-943 | Oryza sativa | |
| miR164 target | No Apical Meristem, ATAF, Cup Shaped Cotyledon (NAC) domain protein | 1288 | MRT4530__178256C.3 | 954-974 | Oryza sativa | |
| miR164 target | No Apical Meristem, ATAF, Cup Shaped Cotyledon (NAC) domain protein | 1289 | MRT4530__211705C.4 | 1929-1949 | Oryza sativa | |
| miR164 target | No Apical Meristem, ATAF, Cup Shaped Cotyledon (NAC) domain protein | 1290 | MRT4530__221769C.1 | 159-179 | Oryza sativa | |
| miR164 target | No Apical Meristem, ATAF, Cup Shaped Cotyledon (NAC) domain protein | 1291 | MRT4530__224181C.2 | 790-810 | Oryza sativa | |
| miR164 target | No Apical Meristem, ATAF, Cup Shaped Cotyledon (NAC) domain protein | 1292 | MRT4558__11465C.1 | 13-33 | Sorghum bicolor | |
| miR164 target | Salicylic acid-induced protein 19, regulation of transcription, DNA binding | 1293 | MRT4558__31046C.1 | 256-276 | Sorghum bicolor | |
| miR164 target | No Apical Meristem, ATAF, Cup Shaped Cotyledon (NAC) domain protein | 1294 | MRT4558__41467C.1 | 1230-1250 | Sorghum bicolor | |
| miR164 target | No Apical Meristem, ATAF, Cup Shaped Cotyledon (NAC) domain protein | 1295 | MRT4558__43081C.1 | 344-364 | Sorghum bicolor | |
| miR164 target | No Apical Meristem, ATAF, Cup Shaped Cotyledon (NAC) domain protein | 1296 | MRT4558__43436C.1 | 853-873 | Sorghum bicolor | |
| miR164 target | No Apical Meristem, ATAF, Cup Shaped Cotyledon (NAC) domain protein | 1297 | MRT4558__4564C.2 | 691-711 | Sorghum bicolor | |
| miR164 target | No Apical Meristem, ATAF, Cup Shaped Cotyledon (NAC) domain protein | 1298 | MRT4565__235741C.1 | 849-869 | Triticum aestivum | |
| miR164 target | No Apical Meristem, ATAF, Cup Shaped Cotyledon (NAC) domain protein | 1299 | MRT4565__241295C.1 | 1062-1082 | Triticum aestivum | |
| miR164 target | SIAH1 protein-like, ubiquitin-dependent protein catabolism, nucleus, zinc ion binding | 1300 | MRT4565__246008C.1 | 696-716 | Triticum aestivum | |

TABLE 3-continued

| Construct type | Name | SEQ ID NO: | Gene ID | Nucleotide Position | Source Organism | Rationale for plant transformation* |
|---|---|---|---|---|---|---|
| miR164 target | No Apical Meristem, ATAF, Cup Shaped Cotyledon (NAC) domain protein | 1301 | MRT4565__250946C.1 | 675-695 | *Triticum aestivum* | |
| miR164 target | No Apical Meristem, ATAF, Cup Shaped Cotyledon (NAC) domain protein | 1302 | MRT4565__269060C.1 | 730-750 | *Triticum aestivum* | |
| miR164 target | Salicylic acid-induced protein 19, regulation of transcription, DNA binding | 1303 | MRT4565__272391C.1 | 765-785 | *Triticum aestivum* | |
| miR164 target | No Apical Meristem, ATAF, Cup Shaped Cotyledon (NAC) domain protein | 1304 | MRT4565__279043C.1 | 945-965 | *Triticum aestivum* | |
| miR164 target | No Apical Meristem, ATAF, Cup Shaped Cotyledon (NAC) domain protein | 1305 | MRT4577__16045C.7 | 927-947 | *Zea mays* | |
| miR164 target | miR164 target | 1306 | MRT4577__205444C.5 | 524-544 | *Zea mays* | |
| miR164 target | hypothetical protein; putative role in boundary specification; nam2 | 1307 | MRT4577__325166C.3 | 868-888 | *Zea mays* | |
| miR164 target | hypothetical protein; putative role in SAM initiation and boundary specification; nam1 | 1308 | MRT4577__78918C.6 | 893-913 | *Zea mays* | |
| miR164 target | miR164 target | 1309 | MRT4577__98755C.5 | 942-962 | *Zea mays* | |
| miR164 target | miR164 target | 1310 | MRT4577__9951C.8 | 930-950 | *Zea mays* | |
| miRNA | miR166 | 1311 | | | *Zea mays* | |
| miR166 target | Revoluta | 1312 | | | *Zea mays* | |
| miRNA-unresponsive | Revoluta (miR166-unresponsive) | 1313 | | | Artificial sequence | Improved yield* |
| miRNA-unresponsive | Revoluta (miR166-unresponsive) | 1314 | | | Artificial sequence | Improved yield* |
| miR166 target | miR166 target | 1315 | MRT3635__23433C.2 | 197-217 | *Gossypium hirsutum* | |
| miR166 target | miR166 target | 1316 | MRT3635__50942C.2 | 298-318 | *Gossypium hirsutum* | |
| miR166 target | interfascicular fiberless 1; IFL1; HDZIPIII domain protein | 1317 | MRT3702__104431C.5 | 1262-1282 | *Arabidopsis thaliana* | |
| miR166 target | homeodomain-leucine zipper protein | 1318 | MRT3702__104605C.6 | 915-935 | *Arabidopsis thaliana* | |
| miR166 target | homeodomain-leucine zipper protein; ATHB-15 | 1319 | MRT3702__113325C.3 | 1268-1288 | *Arabidopsis thaliana* | |
| miR166 target | homeodomain-leucine zipper protein 14; ATHB-14 | 1320 | MRT3702__120571C.3 | 1281-1301 | *Arabidopsis thaliana* | |
| miR166 target | homeodomain-leucine zipper protein 8; hb-8 | 1321 | MRT3702__18869C.5 | 934-954 | *Arabidopsis thaliana* | |
| miR166 target | Glycosyl transferase | 1322 | MRT3702__24778C.3 | 2793-2813 | *Arabidopsis thaliana* | |
| miR166 target | CORONA; START domain; HDZIPIII domain transcription factor | 1323 | MRT3708__45624C.1 | 210-230 | *Brassica napus* | |
| miR166 target | HD-Zip protein (Homeodomain-leucine zipper protein); START domain | 1324 | MRT3708__5493C.1 | 79-99 | *Brassica napus* | |
| miR166 target | Homeodomain-leucine zipper protein; START domain | 1325 | MRT3712__4770C.1 | 229-249 | *Brassica oleracea* | |
| miR166 target | miR166 target | 1326 | MRT3847__209034C.4 | 506-526 | *Glycine max* | |
| miR166 target | miR166 target | 1327 | MRT3847__233286C.5 | 730-750 | *Glycine max* | |
| miR166 target | miR166 target | 1328 | MRT3847__248020C.5 | 298-318 | *Glycine max* | |
| miR166 target | miR166 target | 1329 | MRT3847__251781C.4 | 950-970 | *Glycine max* | |
| miR166 target | miR166 target | 1330 | MRT3847__288367C.4 | 1562-1582 | *Glycine max* | |
| miR166 target | Class III HD-Zip protein 4 | 1331 | MRT3847__296736C.1 | 869-889 | *Glycine max* | |
| miR166 target | Class III HD-Zip protein 4 | 1332 | MRT3847__326691C.1 | 910-930 | *Glycine max* | |

TABLE 3-continued

| Construct type | Name | SEQ ID NO: | Gene ID | Nucleotide Position | Source Organism | Rationale for plant transformation* |
|---|---|---|---|---|---|---|
| miR166 target | miR166 target | 1333 | MRT3847__348410C.1 | 912-932 | Glycine max | |
| miR166 target | Class III HD-Zip protein 8 | 1334 | MRT3880__12194C.1 | 788-808 | Medicago truncatula | |
| miR166 target | Class III HD-Zip protein 1 | 1335 | MRT3880__30145C.1 | 560-580 | Medicago truncatula | |
| miR166 target | Class III HD-Zip protein 6 | 1336 | MRT3880__37546C.1 | 819-839 | Medicago truncatula | |
| miR166 target | Class III HD-Zip protein 6 | 1337 | MRT3880__39764C.1 | 536-556 | Medicago truncatula | |
| miR166 target | homeodomain-leucine zipper protein | 1338 | MRT4530__10527C.4 | 959-979 | Oryza sativa | |
| miR166 target | Homeodomain-leucine zipper protein; START domain | 1339 | MRT4530__107863C.5 | 880-900 | Oryza sativa | |
| miR166 target | Homeodomain leucine-zipper protein Hox10; START domain | 1340 | MRT4530__160340C.3 | 1031-1051 | Oryza sativa | |
| miR166 target | Homeodomain-leucine zipper protein; START domain | 1341 | MRT4530__21619C.2 | 563-583 | Oryza sativa | |
| miR166 target | Homeodomain-leucine zipper protein; START domain | 1342 | MRT4530__253068C.2 | 957-977 | Oryza sativa | |
| miR166 target | Homeodomain-leucine zipper protein; START domain | 1343 | MRT4558__27560C.1 | 750-770 | Sorghum bicolor | |
| miR166 target | Homeodomain-leucine zipper protein; START domain | 1344 | MRT4565__226777C.1 | 285-305 | Triticum aestivum | |
| miR166 target | Homeodomain-leucine zipper protein; START domain | 1345 | MRT4565__232172C.1 | 168-188 | Triticum aestivum | |
| miR166 target | Homeodomain-leucine zipper protein; START domain | 1346 | MRT4565__264759C.1 | 954-973 | Triticum aestivum | |
| miR166 target | miR166 target | 1347 | MRT4577__141500C.4 | 839-859 | Zea mays | |
| miR166 target | miR166 target | 1348 | MRT4577__200605C.3 | 788-808 | Zea mays | |
| miR166 target | rolled leaf1; RLD1; class III homeodomain-leucine zipper (HD-ZIPIII) | 1349 | MRT4577__229497C.6 | 1098-1118 | Zea mays | |
| miR166 target | Rolled leaf1; Homeobox: Homeobox domain; START domain | 1350 | MRT4577__312384C.3 | 563-583 | Zea mays | |
| miR166 target | miR166 target | 1351 | MRT4577__320718C.6 | 963-983 | Zea mays | |
| miR166 target | miR166 target | 1352 | MRT4577__342259C.4 | 1092-1112 | Zea mays | |
| miR166 target | miR166 target | 1353 | MRT4577__442838C.4 | 1159-1179 | Zea mays | |
| miR166 target | miR166 target | 1354 | MRT4577__535676C.2 | 560-580 | Zea mays | |
| miR166 target | miR166 target | 1355 | MRT4577__535928C.2 | 1142-1162 | Zea mays | |
| miR166 target | miR166 target | 1356 | MRT4577__566770C.1 | 545-565 | Zea mays | |
| miR166 target | miR166 target | 1357 | MRT4577__568616C.1 | 801-821 | Zea mays | |
| miR166 target | miR166 target | 1358 | MRT4577__586718C.1 | 572-592 | Zea mays | |
| miR166 target | miR166 target | 1359 | MRT4577__659410C.1 | 788-808 | Zea mays | |
| miR166 target | miR166 target | 1360 | MRT4577__673351C.1 | 161-181 | Zea mays | |
| miRNA | miR167b | 1361 | | | Zea mays | |
| miRNA | miR167b | 1362 | | | Zea mays | |
| miR167 target | ARF8 | 1363 | | | Zea mays | |
| miRNA-unresponsive | ARF8 (mir167-unresponsive) | 1364 | | | Artificial sequence | Improved yield* |
| miR167 target | auxin response factor 8; ARF8; | 1365 | MRT3702__22410C.4 | 4382-4402 | Arabidopsis thaliana | |
| miR167 target | auxin response factor domain; ARF8-like | 1366 | MRT3708__50323C.1 | 89-109 | Brassica napus | |
| miR167 target | miR167 target | 1367 | MRT3847__305421C.4 | 1358-1378 | Glycine max | |
| miR167 target | miR167 target | 1368 | MRT3847__340154C.1 | 1586-1606 | Glycine max | |
| miR167 target | auxin response factor domain; ARF8-like | 1369 | MRT3847__41926C.6 | 1489-1509 | Glycine max | |
| miR167 target | auxin response factor domain; ARF8-like | 1370 | MRT3880__12926C.1 | 365-385 | Medicago truncatula | |
| miR167 target | auxin response factor domain; ARF8-like | 1371 | MRT3880__25270C.1 | 1758-1778 | Medicago truncatula | |
| miR167 target | miR167 target | 1372 | MRT4513__29483C.2 | 564-584 | Hordeum vulgare | |
| miR167 target | miR167 target | 1373 | MRT4530__178528C.2 | 2219-2239 | Oryza sativa | |

TABLE 3-continued

| Construct type | Name | SEQ ID NO: | Gene ID | Nucleotide Position | Source Organism | Rationale for plant transformation* |
|---|---|---|---|---|---|---|
| miR167 target | auxin response factor domain; ARF8-like | 1374 | MRT4530__86291C.3 | 2659-2679 | Oryza sativa | |
| miR167 target | auxin response factor domain; ARF8-like | 1375 | MRT4558__37108C.1 | 147-167 | Sorghum bicolor | |
| miR167 target | miR167 target | 1376 | MRT4577__306050C.5 | 647-667 | Zea mays | |
| miR167 target | miR167 target | 1377 | MRT4577__339989C.4 | 2584-2604 | Zea mays | |
| miR167 target | miR167 target | 1378 | MRT4577__377896C.4 | 244-264 | Zea mays | |
| miR167 target | miR167 target | 1379 | MRT4577__521851C.2 | 1595-1615 | Zea mays | |
| miR167 target | miR167 target | 1380 | MRT4577__650810C.1 | 1618-1638 | Zea mays | |
| miR167 target | miR167 target | 1381 | MRT4577__680014C.1 | 208-228 | Zea mays | |
| miR167 target | miR167 target | 1382 | MRT4577__681995C.1 | 230-250 | Zea mays | |
| miR167 target | miR167 target | 1383 | MRT4577__683953C.1 | 442-462 | Zea mays | |
| miRNA | miR169 | 1384 | | | Zea mays | |
| miRNA | miR169 | 1385 | | | Zea mays | |
| miR169 target | NFY family of TFs | 1386 | | | Zea mays | |
| miRNA-unresponsive | NFY family of TFs (miR169-unresponsive) | 1387 | | | Artificial sequence | Improved yield* |
| miR169 target | HAP2, CCAAT-binding transcription factor (CBF-B/NF-YA) | 1388 | MRT3635__18720C.2 | 1123-1143 | Gossypium hirsutum | |
| miR169 target | HAP2, CCAAT-binding transcription factor (CBF-B/NF-YA) | 1389 | MRT3635__24490C.1 | 345-365 | Gossypium hirsutum | |
| miR169 target | HAP2, CCAAT-binding transcription factor (CBF-B/NF-YA) | 1390 | MRT3635__60547C.1 | 1610-1630 | Gossypium hirsutum | |
| miR169 target | HAP2, CCAAT-binding transcription factor (CBF-B/NF-YA) | 1391 | MRT3635__63203C.1 | 1353-1373 | Gossypium hirsutum | |
| miR169 target | miR169 target | 1392 | MRT3635__63602C.1 | 692-712 | Gossypium hirsutum | |
| miR169 target | HAP2, CCAAT-binding transcription factor (CBF-B/NF-YA) | 1393 | MRT3635__751C.2 | 1156-1176 | Gossypium hirsutum | |
| miR169 target | miR169 target | 1394 | MRT3635__7843C.2 | 302-322 | Gossypium hirsutum | |
| miR169 target | HAP2/CCAAT transcription factor; At3g05690 | 1395 | MRT3702__11008C.6 | 1183-1203 | Arabidopsis thaliana | |
| miR169 target | HAP2A, CCAAT-binding transcription factor (CBF-B/NF-YA) family protein; ATHAP2A, EMBRYO DEFECTIVE 2220 | 1396 | MRT3702__145277C.3 | 1122-1142 | Arabidopsis thaliana | |
| miR169 target | miR169 target | 1397 | MRT3702__145278C.1 | 1870-1890 | Arabidopsis thaliana | |
| miR169 target | HAP2, CCAAT-binding transcription factor (CBF-B/NF-YA) | 1398 | MRT3702__1608C.8 | 1254-1274 | Arabidopsis thaliana | |
| miR169 target | HAP2, CCAAT-binding transcription factor (CBF-B/NF-YA) | 1399 | MRT3702__167062C.2 | 1489-1509 | Arabidopsis thaliana | |
| miR169 target | HAP2C, CCAAT-binding transcription factor (CBF-B/NF-YA) family protein; At1g17590 | 1400 | MRT3702__175138C.1 | 1412-1432 | Arabidopsis thaliana | |
| miR169 target | HAP2A, CCAAT-binding transcription factor (CBF-B/NF-YA) family protein; ATHAP2A, EMBRYO DEFECTIVE 2220 | 1401 | MRT3702__176968C.1 | 1037-1057 | Arabidopsis thaliana | |
| miR169 target | HAP2, CCAAT-binding transcription factor (CBF-B/NF-YA) | 1402 | MRT3702__180826C.1 | 1610-1630 | Arabidopsis thaliana | |
| miR169 target | HAP2, CCAAT-binding transcription factor (CBF-B/NF-YA) | 1403 | MRT3702__20139C.6 | 1305-1325 | Arabidopsis thaliana | |
| miR169 target | HAP2, CCAAT-binding transcription factor (CBF-B/NF-YA) | 1404 | MRT3702__20659C.7 | 1428-1448 | Arabidopsis thaliana | |
| miR169 target | HAP2, CCAAT-binding transcription factor (CBF-B/NF-YA) | 1405 | MRT3702__4133C.5 | 1308-1328 | Arabidopsis thaliana | |

TABLE 3-continued

| Construct type | Name | SEQ ID NO: | Gene ID | Nucleotide Position | Source Organism | Rationale for plant transformation* |
|---|---|---|---|---|---|---|
| miR169 target | HAP2, CCAAT-binding transcription factor (CBF-B/NF-YA) | 1406 | MRT3702_5699C.6 | 1504-1524 | Arabidopsis thaliana | |
| miR169 target | HAP2, CCAAT-binding transcription factor (CBF-B/NF-YA) | 1407 | MRT3708_42756C.1 | 928-948 | Brassica napus | |
| miR169 target | miR169 target | 1408 | MRT3708_45516C.2 | 1074-1094 | Brassica napus | |
| miR169 target | HAP2, CCAAT-binding transcription factor (CBF-B/NF-YA) | 1409 | MRT3708_46224C.1 | 1017-1037 | Brassica napus | |
| miR169 target | HAP2, CCAAT-binding transcription factor (CBF-B/NF-YA) | 1410 | MRT3708_56325C.1 | 670-690 | Brassica napus | |
| miR169 target | HAP2, CCAAT-binding transcription factor (CBF-B/NF-YA) | 1411 | MRT3711_4547C.1 | 157-177 | Brassica rapa | |
| miR169 target | HAP2, CCAAT-binding transcription factor (CBF-B/NF-YA) | 1412 | MRT3712_6671C.1 | 481-501 | Brassica oleracea | |
| miR169 target | HAP2, CCAAT-binding transcription factor (CBF-B/NF-YA) | 1413 | MRT3847_251095C.3 | 995-1015 | Glycine max | |
| miR169 target | HAP2, CCAAT-binding transcription factor (CBF-B/NF-YA) | 1414 | MRT3847_25786C.5 | 1208-1228 | Glycine max | |
| miR169 target | HAP2, CCAAT-binding transcription factor (CBF-B/NF-YA) | 1415 | MRT3847_278998C.2 | 722-742 | Glycine max | |
| miR169 target | miR169 target | 1416 | MRT3847_305217C.3 | 1028-1048 | Glycine max | |
| miR169 target | HAP2, CCAAT-binding transcription factor (CBF-B/NF-YA) | 1417 | MRT3847_312701C.1 | 803-823 | Glycine max | |
| miR169 target | miR169 target | 1418 | MRT3847_335193C.1 | 1452-1472 | Glycine max | |
| miR169 target | HAP2, CCAAT-binding transcription factor (CBF-B/NF-YA) | 1419 | MRT3847_51286C.6 | 801-821 | Glycine max | |
| miR169 target | HAP2, CCAAT-binding transcription factor (CBF-B/NF-YA) | 1420 | MRT3847_53466C.6 | 1490-1510 | Glycine max | |
| miR169 target | HAP2, CCAAT-binding transcription factor (CBF-B/NF-YA) | 1421 | MRT3847_53467C.5 | 902-922 | Glycine max | |
| miR169 target | HAP2, CCAAT-binding transcription factor (CBF-B/NF-YA) | 1422 | MRT3847_54010C.4 | 1403-1423 | Glycine max | |
| miR169 target | HAP2, CCAAT-binding transcription factor (CBF-B/NF-YA) | 1423 | MRT3880_16272C.2 | 1496-1516 | Medicago truncatula | |
| miR169 target | HAP2, CCAAT-binding transcription factor (CBF-B/NF-YA) | 1424 | MRT3880_21811C.2 | 1054-1074 | Medicago truncatula | |
| miR169 target | miR169 target | 1425 | MRT3880_36579C.1 | 90-110 | Medicago truncatula | |
| miR169 target | miR169 target | 1426 | MRT3880_48656C.1 | 73-94 | Medicago truncatula | |
| miR169 target | miR169 target | 1427 | MRT3880_55431C.1 | 145-166 | Medicago truncatula | |
| miR169 target | HAP2, CCAAT-binding transcription factor (CBF-B/NF-YA) | 1428 | MRT3880_59679C.1 | 1268-1288 | Medicago truncatula | |
| miR169 target | miR169 target | 1429 | MRT3880_9392C.1 | 182-202 | Medicago truncatula | |
| miR169 target | HAP2, CCAAT-binding transcription factor (CBF-B/NF-YA) | 1430 | MRT4513_27452C.1 | 721-741 | Hordeum vulgare | |
| miR169 target | HAP2, CCAAT-binding transcription factor (CBF-B/NF-YA) | 1431 | MRT4513_38912C.1 | 1037-1057 | Hordeum vulgare | |
| miR169 target | HAP2, CCAAT-binding transcription factor (CBF-B/NF-YA) | 1432 | MRT4513_51394C.1 | 631-651 | Hordeum vulgare | |
| miR169 target | HAP2, CCAAT-binding transcription factor (CBF-B/NF-YA) | 1433 | MRT4530_156068C.3 | 1715-1735 | Oryza sativa | |

TABLE 3-continued

| Construct type | Name | SEQ ID NO: | Gene ID | Nucleotide Position | Source Organism | Rationale for plant transformation* |
|---|---|---|---|---|---|---|
| miR169 target | miR169 target | 1434 | MRT4530__16169C.4 | 1389-1409 | Oryza sativa | |
| miR169 target | HAP2, CCAAT-binding transcription factor (CBF-B/NF-YA) | 1435 | MRT4530__196466C.4 | 2027-2047 | Oryza sativa | |
| miR169 target | miR169 target | 1436 | MRT4530__223395C.1 | 653-673 | Oryza sativa | |
| miR169 target | RAPB protein; rapB | 1437 | MRT4530__225972C.3 | 867-887 | Oryza sativa | |
| miR169 target | miR169 target | 1438 | MRT4530__238300C.1 | 220-240 | Oryza sativa | |
| miR169 target | HAP2, CCAAT-binding transcription factor (CBF-B/NF-YA) | 1439 | MRT4530__267924C.1 | 1002-1022 | Oryza sativa | |
| miR169 target | HAP2, CCAAT-binding transcription factor (CBF-B/NF-YA) | 1440 | MRT4530__268072C.1 | 756-776 | Oryza sativa | |
| miR169 target | HAP2, CCAAT-binding transcription factor (CBF-B/NF-YA) | 1441 | MRT4530__52650C.3 | 1391-1411 | Oryza sativa | |
| miR169 target | HAP2, CCAAT-binding transcription factor (CBF-B/NF-YA) | 1442 | MRT4530__67920C.7 | 1637-1657 | Oryza sativa | |
| miR169 target | HAP2, CCAAT-binding transcription factor (CBF-B/NF-YA) | 1443 | MRT4530__98042C.6 | 1170-1190 | Oryza sativa | |
| miR169 target | HAP2, CCAAT-binding transcription factor (CBF-B/NF-YA) | 1444 | MRT4558__11671C.2 | 530-550 | Sorghum bicolor | |
| miR169 target | HAP2, CCAAT-binding transcription factor (CBF-B/NF-YA) | 1445 | MRT4558__13240C.2 | 880-900 | Sorghum bicolor | |
| miR169 target | HAP2, CCAAT-binding transcription factor (CBF-B/NF-YA) | 1446 | MRT4558__19368C.2 | 726-746 | Sorghum bicolor | |
| miR169 target | Transcription factor | 1447 | MRT4558__8287C.2 | 346-366 | Sorghum bicolor | |
| miR169 target | miR169 target | 1448 | MRT4565__219265C.1 | 936-956 | Triticum aestivum | |
| miR169 target | HAP2, CCAAT-binding transcription factor (CBF-B/NF-YA) | 1449 | MRT4565__224073C.1 | 1081-1101 | Triticum aestivum | |
| miR169 target | miR169 target | 1450 | MRT4565__232474C.1 | 1040-1060 | Triticum aestivum | |
| miR169 target | miR169 target | 1451 | MRT4565__236768C.1 | 1284-1304 | Triticum aestivum | |
| miR169 target | HAP2, CCAAT-binding transcription factor (CBF-B/NF-YA) | 1452 | MRT4565__240119C.1 | 934-954 | Triticum aestivum | |
| miR169 target | HAP2, CCAAT-binding transcription factor (CBF-B/NF-YA) | 1453 | MRT4565__250357C.1 | 1230-1250 | Triticum aestivum | |
| miR169 target | HAP2, CCAAT-binding transcription factor (CBF-B/NF-YA) | 1454 | MRT4565__270644C.1 | 1050-1070 | Triticum aestivum | |
| miR169 target | miR169 target | 1455 | MRT4565__271488C.1 | 1032-1052 | Triticum aestivum | |
| miR169 target | HAP2, CCAAT-binding transcription factor (CBF-B/NF-YA) | 1456 | MRT4565__271817C.1 | 2171-2191 | Triticum aestivum | |
| miR169 target | miR169 target | 1457 | MRT4565__278167C.1 | 895-915 | Triticum aestivum | |
| miR169 target | miR169 target | 1458 | MRT4577__136204C.6 | 573-593 | Zea mays | |
| miR169 target | miR169 target | 1459 | MRT4577__192239C.6 | 1297-1317 | Zea mays | |
| miR169 target | miR169 target | 1460 | MRT4577__270253C.7 | 1375-1395 | Zea mays | |
| miR169 target | miR169 target | 1461 | MRT4577__321589C.4 | 1051-1071 | Zea mays | |
| miR169 target | miR169 target | 1462 | MRT4577__35015C.6 | 1679-1699 | Zea mays | |
| miR169 target | miR169 target | 1463 | MRT4577__40749C.8 | 1361-1381 | Zea mays | |
| miR169 target | miR169 target | 1464 | MRT4577__411247C.4 | 1445-1465 | Zea mays | |
| miR169 target | miR169 target | 1465 | MRT4577__428392C.4 | 1583-1603 | Zea mays | |
| miR169 target | miR169 target | 1466 | MRT4577__434247C.4 | 671-691 | Zea mays | |
| miR169 target | miR169 target | 1467 | MRT4577__536961C.2 | 920-940 | Zea mays | |
| miR169 target | miR169 target | 1468 | MRT4577__536962C.2 | 1836-1856 | Zea mays | |
| miR169 target | miR169 target | 1469 | MRT4577__540147C.2 | 1327-1347 | Zea mays | |
| miR169 target | miR169 target | 1470 | MRT4577__556372C.2 | 1417-1437 | Zea mays | |
| miR169 target | miR169 target | 1471 | MRT4577__570253C.1 | 340-360 | Zea mays | |

TABLE 3-continued

| Construct type | Name | SEQ ID NO: | Gene ID | Nucleotide Position | Source Organism | Rationale for plant transformation* |
|---|---|---|---|---|---|---|
| miR169 target | miR169 target | 1472 | MRT4577__570254C.1 | 1391-1411 | Zea mays | |
| miR169 target | miR169 target | 1473 | MRT4577__668660C.1 | 1292-1312 | Zea mays | |
| miR169 target | miR169 target | 1474 | MRT4577__693949C.1 | 400-420 | Zea mays | |
| miR169 target | miR169 target | 1475 | MRT4577__701125C.1 | 471-491 | Zea mays | |
| miR169 target | miR169 target | 1476 | MRT4577__72313C.1 | 262-282 | Zea mays | |
| miRNA | miR171b | 1477 | | | Zea mays | |
| miRNA precursor for overexpression of mature miR171 | osa-MIR171b (precursor) | 1478 | | | Oryza sativa | Improved yield* |
| miR171 target | Scarecrow-like Scl1 protein (3e−37); GRAS family transcription factor | 1479 | MRT4577__520619C.1 | 106-126 | Zea mays | |
| miR171 target | Scarecrow-like Scl1 protein (3e−37); GRAS family transcription factor | 1480 | MRT4577__139132C.5 | 1336-1356 | Zea mays | |
| miR171 target | Scarecrow-like Scl1 protein (3e−37); GRAS family transcription factor | 1481 | MRT4577__75777C.7 | 640-660 | Zea mays | |
| miR171 target | Scarecrow-like Scl1 protein (3e−37); GRAS family transcription factor | 1482 | MRT4577__234039C.5 | 771-791 | Zea mays | |
| miR171 target | Scarecrow-like Scl1 protein (3e−37); GRAS family transcription factor | 1483 | MRT4577__57336C.8 | 1274-1294 | Zea mays | |
| miR171 target | Scarecrow-like Scl1 protein (3e−37); GRAS family transcription factor | 1484 | MRT4577__140896C.5 | 507-527 | Zea mays | |
| miR171 target | Scarecrow-like Scl1 protein (3e−37); GRAS family transcription factor | 1485 | MRT4577__30852C.5 | 800-820 | Zea mays | |
| miRNA | miR172 | 1486 | | | Zea mays | |
| miRNA | miR172 | 1487 | | | Zea mays | |
| miR172 target | Glossy15 | 1488 | | | Zea mays | |
| Decoy | miR172 decoy | 1489 | | | Artificial sequence | Improved yield* |
| Decoy | miR172 decoy | 1490 | | | Artificial sequence | Improved yield* |
| Decoy | miR172 decoy | 1491 | | | Artificial sequence | Improved yield* |
| miRNA | miRMON18 | 1492 | | | Zea mays | |
| Cleavage blocker | mirR172 cleavage blocker | 1493 | | | Artificial sequence | Improved yield* |
| miR172 target | AP2 domain transcription factor; SCHNARCHZAPFEN; SNZ | 1494 | MRT3635__50596C.2 | 622-642 | Gossypium hirsutum | |
| miR172 target | AP2 domain transcription factor; SCHNARCHZAPFEN; SNZ | 1495 | MRT3635__64291C.1 | 246-266 | Gossypium hirsutum | |
| miR172 target | AP2 domain transcription factor; SCHNARCHZAPFEN; SNZ | 1496 | MRT3635__64989C.1 | 1102-1122 | Gossypium hirsutum | |
| miR172 target | miR172 target | 1497 | MRT3635__65450C.1 | 241-261 | Gossypium hirsutum | |
| miR172 target | miR172 target | 1498 | MRT3635__70864C.1 | 646-666 | Gossypium hirsutum | |
| miR172 target | AP2 domain transcription factor; SCHNARCHZAPFEN; SNZ | 1499 | MRT3635__8244C.2 | 1657-1677 | Gossypium hirsutum | |
| miR172 target | AP2 domain transcription factor; SCHNARCHZAPFEN; SNZ | 1500 | MRT3702__103726C.5 | 1044-1064 | Arabidopsis thaliana | |

TABLE 3-continued

| Construct type | Name | SEQ ID NO: | Gene ID | Nucleotide Position | Source Organism | Rationale for plant transformation* |
|---|---|---|---|---|---|---|
| miR172 target | AP2 domain containing protein RAP2.7 | 1501 | MRT3702__103748C.5 | 1560-1580 | *Arabidopsis thaliana* | |
| miR172 target | AP2 domain transcription factor; SCHLAFMUTZE; SMZ | 1502 | MRT3702__14904C.2 | 1095-1115 | *Arabidopsis thaliana* | |
| miR172 target | AP2 domain transcription factor-like | 1503 | MRT3702__150241C.1 | 947-967 | *Arabidopsis thaliana* | |
| miR172 target | AP2 domain transcription factor-like | 1504 | MRT3702__156728C.3 | 1030-1050 | *Arabidopsis thaliana* | |
| miR172 target | APETALA2; AP2 | 1505 | MRT3702__168284C.1 | 1271-1291 | *Arabidopsis thaliana* | |
| miR172 target | AP2 domain-containing transcription factor RAP2.7 | 1506 | MRT3702__175574C.1 | 1630-1650 | *Arabidopsis thaliana* | |
| miR172 target | AP2 domain transcription factor; SCHNARCHZAPFEN; SNZ | 1507 | MRT3702__179746C.1 | 263-283 | *Arabidopsis thaliana* | |
| miR172 target | AP2 domain transcription factor-like | 1508 | MRT3702__19267C.5 | 1368-1388 | *Arabidopsis thaliana* | |
| miR172 target | elongation factor 2-like | 1509 | MRT3702__4319C.8 | 1045-1065 | *Arabidopsis thaliana* | |
| miR172 target | AP2 domain transcription factor; SCHNARCHZAPFEN; SNZ | 1510 | MRT3702__76733C.6 | 1663-1683 | *Arabidopsis thaliana* | |
| miR172 target | AP2 domain transcription factor-like | 1511 | MRT3708__36942C.2 | 411-431 | *Brassica napus* | |
| miR172 target | AP2 domain transcription factor-like | 1512 | MRT3708__39387C.1 | 366-386 | *Brassica napus* | |
| miR172 target | AP2 domain transcription factor-like | 1513 | MRT3711__6838C.1 | 137-157 | *Brassica rapa* | |
| miR172 target | miR172 target | 1514 | MRT3847__196945C.3 | 667-687 | *Glycine max* | |
| miR172 target | AP2 domain transcription factor-like | 1515 | MRT3847__202930C.3 | 1630-1650 | *Glycine max* | |
| miR172 target | AP2 domain transcription factor-like | 1516 | MRT3847__235857C.3 | 1789-1809 | *Glycine max* | |
| miR172 target | miR172 target | 1517 | MRT3847__257655C.4 | 1984-2004 | *Glycine max* | |
| miR172 target | AP2 domain transcription factor-like | 1518 | MRT3847__289890C.3 | 2213-2233 | *Glycine max* | |
| miR172 target | miR172 target | 1519 | MRT3847__289891C.3 | 529-549 | *Glycine max* | |
| miR172 target | AP2 domain transcription factor-like | 1520 | MRT3847__295726C.1 | 1539-1559 | *Glycine max* | |
| miR172 target | AP2 domain transcription factor-like | 1521 | MRT3847__326790C.1 | 1269-1289 | *Glycine max* | |
| miR172 target | AP2 domain transcription factor-like | 1522 | MRT3847__329301C.1 | 775-795 | *Glycine max* | |
| miR172 target | miR172 target | 1523 | MRT3847__344570C.1 | 564-584 | *Glycine max* | |
| miR172 target | AP2 domain transcription factor-like | 1524 | MRT3847__43925C.7 | 811-831 | *Glycine max* | |
| miR172 target | AP2 domain transcription factor-like | 1525 | MRT3847__46007C.5 | 1544-1564 | *Glycine max* | |
| miR172 target | AP2 domain transcription factor-like | 1526 | MRT3847__51633C.3 | 910-930 | *Glycine max* | |
| miR172 target | miR172 target | 1527 | MRT3847__59804C.6 | 2369-2389 | *Glycine max* | |
| miR172 target | AP2 domain transcription factor-like | 1528 | MRT3880__19283C.1 | 558-578 | *Medicago truncatula* | |
| miR172 target | AP2 domain transcription factor-like | 1529 | MRT3880__32459C.1 | 311-331 | *Medicago truncatula* | |
| miR172 target | AP2 domain transcription factor-like | 1530 | MRT3880__36568C.1 | 1424-1444 | *Medicago truncatula* | |
| miR172 target | AP2 domain transcription factor-like | 1531 | MRT3880__39959C.1 | 1689-1709 | *Medicago truncatula* | |
| miR172 target | AP2 domain transcription factor-like | 1532 | MRT3880__55789C.1 | 1241-1261 | *Medicago truncatula* | |
| miR172 target | AP2 domain transcription factor-like | 1533 | MRT4513__42015C.1 | 1464-1484 | *Hordeum vulgare* | |
| miR172 target | AP2 domain transcription factor-like | 1534 | MRT4513__6417C.1 | 632-652 | *Hordeum vulgare* | |
| miR172 target | miR172 target | 1535 | MRT4530__140532C.4 | 1358-1378 | *Oryza sativa* | |
| miR172 target | AP2 domain transcription factor; SCHNARCHZAPFEN; SNZ | 1536 | MRT4530__146548C.4 | 669-689 | *Oryza sativa* | |

TABLE 3-continued

| Construct type | Name | SEQ ID NO: | Gene ID | Nucleotide Position | Source Organism | Rationale for plant transformation* |
|---|---|---|---|---|---|---|
| miR172 target | AP2 domain transcription factor-like | 1537 | MRT4530__160275C.3 | 1405-1425 | Oryza sativa | |
| miR172 target | miR172 target | 1538 | MRT4530__16723C.7 | 804-824 | Oryza sativa | |
| miR172 target | AP2 domain transcription factor; SCHNARCHZAPFEN; SNZ | 1539 | MRT4530__209082C.4 | 1976-1996 | Oryza sativa | |
| miR172 target | AP2 domain transcription factor-like | 1540 | MRT4530__212672C.3 | 187-207 | Oryza sativa | |
| miR172 target | miR172 target | 1541 | MRT4530__238241C.2 | 1481-1501 | Oryza sativa | |
| miR172 target | AP2 domain transcription factor; SCHNARCHZAPFEN; SNZ | 1542 | MRT4530__263068C.2 | 1768-1788 | Oryza sativa | |
| miR172 target | miR172 target | 1543 | MRT4530__266671C.1 | 2391-2411 | Oryza sativa | |
| miR172 target | miR172 target | 1544 | MRT4530__272652C.1 | 378-398 | Oryza sativa | |
| miR172 target | miR172 target | 1545 | MRT4530__274692C.1 | 236-256 | Oryza sativa | |
| miR172 target | AP2 domain transcription factor-like | 1546 | MRT4530__56773C.3 | 1148-1168 | Oryza sativa | |
| miR172 target | Zinc finger (C3HC4-type RING finger)protein-like, transport, nucleus, metal ion binding | 1547 | MRT4530__57252C.7 | 41-61 | Oryza sativa | |
| miR172 target | miR172 target | 1548 | MRT4558__24999C.3 | 298-318 | Sorghum bicolor | |
| miR172 target | AP2 domain transcription factor; SCHNARCHZAPFEN; SNZ | 1549 | MRT4558__25704C.2 | 512-532 | Sorghum bicolor | |
| miR172 target | miR172 target | 1550 | MRT4565__108668C.1 | 220-240 | Triticum aestivum | |
| miR172 target | AP2 domain transcription factor-like | 1551 | MRT4565__118657C.1 | 354-374 | Triticum aestivum | |
| miR172 target | AP2 domain transcription factor-like | 1552 | MRT4565__235388C.1 | 572-592 | Triticum aestivum | |
| miR172 target | AP2 domain transcription factor-like | 1553 | MRT4565__245146C.1 | 1148-1168 | Triticum aestivum | |
| miR172 target | AP2 domain transcription factor-like | 1554 | MRT4565__247090C.1 | 1462-1482 | Triticum aestivum | |
| miR172 target | miR172 target | 1555 | MRT4565__249252C.1 | 551-571 | Triticum aestivum | |
| miR172 target | AP2 domain transcription factor-like | 1556 | MRT4565__256056C.1 | 810-830 | Triticum aestivum | |
| miR172 target | AP2 domain transcription factor-like | 1557 | MRT4565__273183C.1 | 1152-1172 | Triticum aestivum | |
| miR172 target | AP2 domain transcription factor-like | 1558 | MRT4565__279009C.1 | 1155-1175 | Triticum aestivum | |
| miR172 target | miR172 target | 1559 | MRT4565__83602C.3 | 26-46 | Triticum aestivum | |
| miR172 target | Glycosyltransferase | 1560 | MRT4565__88032C.3 | 361-381 | Triticum aestivum | |
| miR172 target | miR172 target | 1561 | MRT4577__12523C.7 | 2414-2434 | Zea mays | |
| miR172 target | miR172 target | 1562 | MRT4577__243746C.1 | 140-160 | Zea mays | |
| miR172 target | miR172 target | 1563 | MRT4577__27478C.9 | 1546-1566 | Zea mays | |
| miR172 target | miR172 target | 1564 | MRT4577__304712C.4 | 1326-1346 | Zea mays | |
| miR172 target | miR172 target | 1565 | MRT4577__307553C.7 | 1508-1528 | Zea mays | |
| miR172 target | AP2 domain transcription factor-like | 1566 | MRT4577__39951C.8 | 1611-1631 | Zea mays | |
| miR172 target | miR172 target | 1567 | MRT4577__431122C.3 | 1359-1379 | Zea mays | |
| miR172 target | miR172 target | 1568 | MRT4577__431125C.4 | 824-844 | Zea mays | |
| miR172 target | miR172 target | 1569 | MRT4577__455774C.3 | 963-983 | Zea mays | |
| miR172 target | miR172 target | 1570 | MRT4577__468762C.3 | 2414-2434 | Zea mays | |
| miR172 target | miR172 target | 1571 | MRT4577__49516C.9 | 408-428 | Zea mays | |
| miR172 target | AP2 domain transcription factor-like | 1572 | MRT4577__49517C.8 | 1652-1672 | Zea mays | |
| miR172 target | miR172 target | 1573 | MRT4577__548310C.2 | 1451-1471 | Zea mays | |
| miR172 target | miR172 target | 1574 | MRT4577__556612C.2 | 1352-1372 | Zea mays | |
| miR172 target | miR172 target | 1575 | MRT4577__597136C.1 | 551-571 | Zea mays | |
| miR172 target | miR172 target | 1576 | MRT4577__616573C.1 | 670-690 | Zea mays | |
| miR172 target | miR172 target | 1577 | MRT4577__668951C.1 | 270-290 | Zea mays | |

TABLE 3-continued

| Construct type | Name | SEQ ID NO: | Gene ID | Nucleotide Position | Source Organism | Rationale for plant transformation* |
|---|---|---|---|---|---|---|
| miR172 target | miR172 target | 1578 | MRT4577__669210C.1 | 1031-1051 | Zea mays | |
| miR172 target | miR172 target | 1579 | MRT4577__676464C.1 | 1308-1328 | Zea mays | |
| miR172 target | miR172 target | 1580 | MRT4577__679724C.1 | 157-177 | Zea mays | |
| miR172 target | miR172 target | 1581 | MRT4577__700043C.1 | 147-167 | Zea mays | |
| miR172 target | miR172 target | 1582 | MRT4577__701524C.1 | 136-156 | Zea mays | |
| miR172 target | miR172 target | 1583 | MRT4577__708079C.1 | 540-560 | Zea mays | |
| miRNA | miR319 | 1584 | | | Zea mays | |
| miRNA precursor for overexpression of mature miR319 | osa-MIR319 (precursor) | 1585 | | | Oryza sativa | Improved yield* |
| miR319 target | TCP family transcription factor | 1586 | MRT4577__275782C.5 | 1673-1692 | Zea mays | |
| miR319 target | TCP family transcription factor | 1587 | MRT4577__558102C.1 | 949-968 | Zea mays | |
| miR319 target | TCP family transcription factor | 1588 | MRT4577__30525C.5 | 1316-1335 | Zea mays | |
| miR319 target | TCP family transcription factor | 1589 | MRT4577__275060C.2 | 818-836 | Zea mays | |
| miR319 target | TCP family transcription factor | 1590 | MRT4577__22397C.4 | 943-961 | Zea mays | |
| miR319 target | TCP family transcription factor | 1591 | MRT4577__275063C.5 | 1247-1265 | Zea mays | |
| miR319 target | TCP family transcription factor | 1592 | MRT4577__480991C.1 | 150-169 | Zea mays | |
| miR319 target | TCP family transcription factor | 1593 | MRT4577__427906C.3 | 1557-1576 | Zea mays | |
| miR319 target | TCP family transcription factor | 1594 | MRT4577__213173C.3 | 1594-1613 | Zea mays | |
| miRNA | miR396 | 1595 | | | Zea mays | |
| miR396 target | Zm-GRF1 | 1596 | | | Zea mays | |
| Decoy | miR396 decoy | 1597 | | | Artificial construct | Improved yield* |
| Decoy | miR396 decoy | 1598 | | | Artificial sequence | Improved yield* |
| Decoy | miR396 decoy | 1599 | | | Artificial sequence | Improved yield* |
| miR396 target | miR396 target | 1600 | MRT3635__67262C.1 | 6-25 | Gossypium hirsutum | |
| miR396 target | miR396 target | 1601 | MRT3635__70418C.1 | 147-166 | Gossypium hirsutum | |
| miR396 target | miR396 target | 1602 | MRT3635__71272C.1 | 414-433 | Gossypium hirsutum | |
| miR396 target | miR396 target | 1603 | MRT3635__71696C.1 | 37-56 | Gossypium hirsutum | |
| miR396 target | ATP-dependent RNA helicase-like protein | 1604 | MRT3702__15262C.6 | 1141-1160 | Arabidopsis thaliana | |
| miR396 target | subtilase family protein, contains Pfam profile: PF00082 subtilase family | 1605 | MRT3702__17628C.6 | 1886-1905 | Arabidopsis thaliana | |
| miR396 target | miR396 target | 1606 | MRT3702__18069C.6 | 2763-2782 | Arabidopsis thaliana | |
| miR396 target | miR396 target | 1607 | MRT3702__2454C.7 | 1387-1406 | Arabidopsis thaliana | |
| miR396 target | miR396 target | 1608 | MRT3708__59476C.1 | 194-213 | Brassica napus | |
| miR396 target | miR396 target | 1609 | MRT3708__61891C.1 | 236-255 | Brassica napus | |
| miR396 target | Cysteine proteinase precursor, proteolysis; cysteine-type endopeptidase activity | 1610 | MRT3847__115000C.2 | 180-199 | Glycine max | |
| miR396 target | miR396 target | 1611 | MRT3847__249313C.3 | 1165-1184 | Glycine max | |
| miR396 target | Putative fimbriata, ubiquitin cycle, nucleus, protein binding | 1612 | MRT3847__260044C.4 | 1337-1356 | Glycine max | |
| miR396 target | miR396 target | 1613 | MRT3847__282324C.5 | 578-597 | Glycine max | |
| miR396 target | Microsomal cytochrome b5, electron transport, mitochondrial inner membrane, iron ion binding | 1614 | MRT3847__32554C.3 | 245-264 | Glycine max | |

TABLE 3-continued

| Construct type | Name | SEQ ID NO: | Gene ID | Nucleotide Position | Source Organism | Rationale for plant transformation* |
|---|---|---|---|---|---|---|
| miR396 target | BRASSINOSTEROID INSENSITIVE 1-associated receptor kinase 1 precursor (EC 2.7.11.1) (BRI1-associated receptor kinase 1) (Somatic embryogenesis receptor-like kinase 3), protein amino acid phosphorylation, integral to membrane, protein serine/threonine kinase activity | 1615 | MRT3847__60193C.5 | 1967-1986 | Glycine max | |
| miR396 target | miR396 target | 1616 | MRT3847__72393C.1 | 34-53 | Glycine max | |
| miR396 target | Putative AFG1-like ATPase | 1617 | MRT4513__2056C.1 | 294-313 | Hordeum vulgare | |
| miR396 target | Putative fimbriata, cell differentiation, nucleus, protein binding | 1618 | MRT4513__23211C.1 | 721-740 | Hordeum vulgare | |
| miR396 target | Cryptochrome 2, DNA repair, DNA photolyase activity | 1619 | MRT4513__24452C.1 | 19-38 | Hordeum vulgare | |
| miR396 target | miR396 target | 1620 | MRT4513__32857C.1 | 621-640 | Hordeum vulgare | |
| miR396 target | S-locus protein 5 | 1621 | MRT4513__48780C.1 | 84-103 | Hordeum vulgare | |
| miR396 target | miR396 target | 1622 | MRT4530__139664C.5 | 2371-2390 | Oryza sativa | |
| miR396 target | Putative RNA polymerase III, RNA_pol_Rpb2_1: RNA polymerase beta subunit, RNA_pol_Rpb2_3: RNA polymerase Rpb2, domain 3, RNA_pol_Rpb2_4: RNA polymerase Rpb2, domain 4, RNA_pol_Rpb2_5: RNA polymerase Rpb2, domain 5, RNA_pol_Rpb2_6: RNA polymerase Rpb2, domain 6, RNA_pol_Rpb2_7: RNA polymerase Rpb2, domain 7; transcription; nucleus; metal ion binding | 1623 | MRT4530__171648C.2 | 1063-1082 | Oryza sativa | |
| miR396 target | miR396 target | 1624 | MRT4530__267934C.1 | 467-486 | Oryza sativa | |
| miR396 target | miR396 target | 1625 | MRT4530__268027C.1 | 95-114 | Oryza sativa | |
| miR396 target | miR396 target | 1626 | MRT4530__27400C.6 | 682-701 | Oryza sativa | |
| miR396 target | miR396 target | 1627 | MRT4530__59122C.7 | 573-591 | Oryza sativa | |
| miR396 target | miR396 target | 1628 | MRT4530__62393C.7 | 2341-2360 | Oryza sativa | |
| miR396 target | miR396 target | 1629 | MRT4530__81835C.6 | 1243-1262 | Oryza sativa | |
| miR396 target | Hypothetical protein P0698A04.3; GRP: Glycine rich protein family | 1630 | MRT4530__98651C.4 | 271-290 | Oryza sativa | |
| miR396 target | Putative fimbriata, F-box: F-box domain | 1631 | MRT4558__11973C.2 | 1234-1253 | Sorghum bicolor | |
| miR396 target | Methyltransferase, putative, cell wall (sensu Magnoliophyta), methyltransferase activity | 1632 | MRT4558__29180C.1 | 101-120 | Sorghum bicolor | |
| miR396 target | miR396 target | 1633 | MRT4558__34091C.1 | 266-285 | Sorghum bicolor | |

TABLE 3-continued

| Construct type | Name | SEQ ID NO: | Gene ID | Nucleotide Position | Source Organism | Rationale for plant transformation* |
|---|---|---|---|---|---|---|
| miR396 target | Putative receptor-like kinase; Pkinase_Tyr: Protein tyrosine kinase, protein amino acid phosphorylation, integral to membrane, protein-tyrosine kinase activity | 1634 | MRT4558_9324C.2 | 375-394 | Sorghum bicolor | |
| miR396 target | Acyl-CoA dehydrogenase, putative | 1635 | MRT4565_127266C.2 | 27-46 | Triticum aestivum | |
| miR396 target | miR396 target | 1636 | MRT4565_162831C.1 | 1134-1153 | Triticum aestivum | |
| miR396 target | Ribulose-1,5-bisphosphate carboxylase/oxygenase small subunit | 1637 | MRT4565_200090C.1 | 1047-1066 | Triticum aestivum | |
| miR396 target | Putative fimbriata | 1638 | MRT4565_230957C.1 | 450-469 | Triticum aestivum | |
| miR396 target | Dirigent-like protein | 1639 | MRT4565_234418C.1 | 1427-1446 | Triticum aestivum | |
| miR396 target | putative F-box protein | 1640 | MRT4565_242541C.1 | 1472-1491 | Triticum aestivum | |
| miR396 target | Putative folylpolyglutamate synthetase, folic acid and derivative biosynthesis, extracellular space, ATP binding | 1641 | MRT4565_244837C.1 | 918-937 | Triticum aestivum | |
| miR396 target | miR396 target | 1642 | MRT4565_248632C.1 | 625-644 | Triticum aestivum | |
| miR396 target | miR396 target | 1643 | MRT4565_249453C.1 | 108-127 | Triticum aestivum | |
| miR396 target | Folylpolyglutamate synthetase, putative, folic acid and derivative biosynthesis, ATP binding (4e−99) | 1644 | MRT4565_253149C.1 | 616-635 | Triticum aestivum | |
| miR396 target | Phytochrome/protein kinase-like, protein amino acid phosphorylation, protein-tyrosine kinase activity | 1645 | MRT4565_253747C.1 | 894-913 | Triticum aestivum | |
| miR396 target | Putative fimbriata | 1646 | MRT4565_259298C.1 | 1362-1381 | Triticum aestivum | |
| miR396 target | Putative fimbriata | 1647 | MRT4565_260134C.1 | 414-433 | Triticum aestivum | |
| miR396 target | miR396 target | 1648 | MRT4565_273137C.1 | 137-156 | Triticum aestivum | |
| miR396 target | Putative dihydrolipoamide S-acetyltransferase; Biotin_lipoyl: Biotin-requiring enzyme, metabolism, mitochondrion, dihydrolipoyllysine-residue acetyltransferase activity | 1649 | MRT4577_130243C.1 | 12-31 | Zea mays | |
| miR396 target | miR396 target | 1650 | MRT4577_165771C.1 | 95-114 | Zea mays | |
| miR396 target | miR396 target | 1651 | MRT4577_213750C.1 | 60-79 | Zea mays | |
| miR396 target | miR396 target | 1652 | MRT4577_26483C.7 | 805-824 | Zea mays | |
| miR396 target | miR396 target | 1653 | MRT4577_341149C.6 | 1110-1129 | Zea mays | |
| miR396 target | miR396 target | 1654 | MRT4577_355112C.1 | 159-177 | Zea mays | |
| miR396 target | Putative gag-pol | 1655 | MRT4577_406214C.1 | 376-395 | Zea mays | |
| miR396 target | beta-keto acyl reductase; cuticular wax biosynthesis; glossy8 | 1656 | MRT4577_416676C.5 | 1463-1482 | Zea mays | |
| miR396 target | miR396 target | 1657 | MRT4577_521629C.3 | 555-574 | Zea mays | |
| miR396 target | miR396 target | 1658 | MRT4577_540304C.2 | 1355-1374 | Zea mays | |
| miR396 target | miR396 target | 1659 | MRT4577_540948C.2 | 1095-1114 | Zea mays | |
| miR396 target | miR396 target | 1660 | MRT4577_548836C.1 | 467-486 | Zea mays | |

TABLE 3-continued

| Construct type | Name | SEQ ID NO: | Gene ID | Nucleotide Position | Source Organism | Rationale for plant transformation* |
|---|---|---|---|---|---|---|
| miR396 target | Retrotransposon protein, putative, unclassified; Retrotrans_gag: Retrotransposon gag protein, RNA-dependent DNA replication, nucleus, RNA-directed DNA polymerase activity | 1661 | MRT4577__555855C.1 | 148-167 | Zea mays | |
| miR396 target | miR396 target | 1662 | MRT4577__557678C.2 | 344-363 | Zea mays | |
| miR396 target | miR396 target | 1663 | MRT4577__561121C.1 | 956-975 | Zea mays | |
| miR396 target | miR396 target | 1664 | MRT4577__564288C.1 | 290-309 | Zea mays | |
| miR396 target | miR396 target | 1665 | MRT4577__56429C.8 | 1315-1334 | Zea mays | |
| miR396 target | miR396 target | 1666 | MRT4577__595828C.1 | 63-82 | Zea mays | |
| miR396 target | miR396 target | 1667 | MRT4577__613832C.1 | 1029-1048 | Zea mays | |
| miR396 target | miR396 target | 1668 | MRT4577__619443C.1 | 394-413 | Zea mays | |
| miR396 target | miR396 target | 1669 | MRT4577__635169C.1 | 602-621 | Zea mays | |
| miR396 target | miR396 target | 1670 | MRT4577__638921C.1 | 172-191 | Zea mays | |
| miR396 target | miR396 target | 1671 | MRT4577__664914C.1 | 581-600 | Zea mays | |
| miRNA | miR393 | 1672 | | | Zea mays | |
| miR393 target | TIR1-like transport inhibitor response-like protein | 1673 | MRT3635__18188C.2 | 746-766 | Gossypium hirsutum | |
| miR393 target | TIR1-like transport inhibitor response-like protein | 1674 | MRT3635__18850C.2 | 171-191 | Gossypium hirsutum | |
| miR393 target | TIR1-like transport inhibitor response-like protein | 1675 | MRT3635__35639C.2 | 1049-1069 | Gossypium hirsutum | |
| miR393 target | TIR1-like transport inhibitor response-like protein | 1676 | MRT3635__49076C.2 | 373-393 | Gossypium hirsutum | |
| miR393 target | TIR1-like transport inhibitor response-like protein | 1677 | MRT3635__68504C.1 | 1996-2016 | Gossypium hirsutum | |
| miR393 target | TIR1-like transport inhibitor response-like protein; At3g26830 | 1678 | MRT3702__13118C.8 | 2015-2035 | Arabidopsis thaliana | |
| miR393 target | TIR1-like transport inhibitor response-like protein | 1679 | MRT3702__145409C.1 | 1508-1528 | Arabidopsis thaliana | |
| miR393 target | TIR1-like transport inhibitor response-like protein | 1680 | MRT3702__15703C.8 | 1738-1758 | Arabidopsis thaliana | |
| miR393 target | TIR1-like transport inhibitor response-like protein | 1681 | MRT3702__16076C.7 | 1587-1607 | Arabidopsis thaliana | |
| miR393 target | TIR1-like transport inhibitor response-like protein; At1g12820 | 1682 | MRT3702__92498C.6 | 1898-1918 | Arabidopsis thaliana | |
| miR393 target | TIR1-like transport inhibitor response-like protein | 1683 | MRT3708__31301C.1 | 259-280 | Brassica napus | |
| miR393 target | TIR1-like transport inhibitor response-like protein | 1684 | MRT3708__52518C.1 | 250-270 | Brassica napus | |
| miR393 target | TIR1-like transport inhibitor response-like protein | 1685 | MRT3708__55951C.1 | 93-113 | Brassica napus | |
| miR393 target | TIR1-like transport inhibitor response-like protein | 1686 | MRT3711__1771C.1 | 103-123 | Brassica rapa | |
| miR393 target | TIR1-like transport inhibitor response-like protein | 1687 | MRT3847__238705C.4 | 1172-1192 | Glycine max | |
| miR393 target | TIR1-like transport inhibitor response-like protein | 1688 | MRT3847__27973C.7 | 1339-1359 | Glycine max | |
| miR393 target | miR393 target | 1689 | MRT3847__313402C.3 | 958-978 | Glycine max | |
| miR393 target | miR393 target | 1690 | MRT3847__329954C.2 | 1740-1760 | Glycine max | |
| miR393 target | miR393 target | 1691 | MRT3847__335477C.1 | 1715-1735 | Glycine max | |
| miR393 target | miR393 target | 1692 | MRT3847__338734C.1 | 1474-1494 | Glycine max | |
| miR393 target | TIR1-like transport inhibitor response-like protein | 1693 | MRT3847__44371C.6 | 2345-2365 | Glycine max | |

TABLE 3-continued

| Construct type | Name | SEQ ID NO: | Gene ID | Nucleotide Position | Source Organism | Rationale for plant transformation* |
|---|---|---|---|---|---|---|
| miR393 target | miR393 target | 1694 | MRT3880__18564C.2 | 3116-3136 | Medicago truncatula | |
| miR393 target | TIR1-like transport inhibitor response-like protein | 1695 | MRT3880__38847C.1 | 139-159 | Medicago truncatula | |
| miR393 target | TIR1-like transport inhibitor response-like protein | 1696 | MRT4513__12741C.1 | 197-217 | Hordeum vulgare | |
| miR393 target | TIR1-like transport inhibitor response-like protein | 1697 | MRT4513__38675C.1 | 419-439 | Hordeum vulgare | |
| miR393 target | miR393 target | 1698 | MRT4530__113561C.5 | 5590-5610 | Oryza sativa | |
| miR393 target | TIR1-like transport inhibitor response-like protein | 1699 | MRT4530__237446C.2 | 2221-2241 | Oryza sativa | |
| miR393 target | TIR1-like transport inhibitor response-like protein | 1700 | MRT4530__241313C.2 | 1706-1726 | Oryza sativa | |
| miR393 target | TIR1-like transport inhibitor response-like protein | 1701 | MRT4558__1226C.2 | 167-187 | Sorghum bicolor | |
| miR393 target | TIR1-like transport inhibitor response-like protein | 1702 | MRT4558__20000C.2 | 412-432 | Sorghum bicolor | |
| miR393 target | TIR1-like transport inhibitor response-like protein | 1703 | MRT4565__141193C.1 | 43-63 | Triticum aestivum | |
| miR393 target | TIR1-like transport inhibitor response-like protein | 1704 | MRT4565__226582C.1 | 486-506 | Triticum aestivum | |
| miR393 target | TIR1-like transport inhibitor response-like protein | 1705 | MRT4565__247449C.1 | 28-48 | Triticum aestivum | |
| miR393 target | TIR1-like transport inhibitor response-like protein | 1706 | MRT4565__274399C.1 | 1499-1519 | Triticum aestivum | |
| miR393 target | miR393 target | 1707 | MRT4577__262597C.7 | 2373-2393 | Zea mays | |
| miR393 target | miR393 target | 1708 | MRT4577__39097C.9 | 1716-1736 | Zea mays | |
| miR393 target | miR393 target | 1709 | MRT4577__546333C.2 | 1349-1369 | Zea mays | |
| miR393 target | miR393 target | 1710 | MRT4577__656737C.1 | 1325-1345 | Zea mays | |
| miRNA | miR395 | 1711 | | | Zea mays | |
| miR395 target | ATP sulfurylase domain protein | 1712 | | | Zea mays | |
| Decoy | miR395 decoy | 1713 | | | Artificial sequence | Improved yield* |
| miR395 target | ATP sulfurylase domain protein | 1714 | MRT3635__15903C.2 | 410-429 | Gossypium hirsutum | |
| miR395 target | ATP sulfurylase domain protein | 1715 | MRT3635__48567C.2 | 480-499 | Gossypium hirsutum | |
| miR395 target | ATP sulfurylase domain protein | 1716 | MRT3702__166264C.1 | 202-221 | Arabidopsis thaliana | |
| miR395 target | Sulfate transporter | 1717 | MRT3702__169467C.1 | 107-126 | Arabidopsis thaliana | |
| miR395 target | ATP sulfurylase domain protein | 1718 | MRT3702__17054C.8 | 470-489 | Arabidopsis thaliana | |
| miR395 target | ATP sulfurylase domain protein | 1719 | MRT3702__177422C.1 | 340-359 | Arabidopsis thaliana | |
| miR395 target | Sulfate transporter | 1720 | MRT3702__20451C.6 | 125-144 | Arabidopsis thaliana | |
| miR395 target | ATP sulfurylase domain protein | 1721 | MRT3702__23086C.8 | 544-563 | Arabidopsis thaliana | |
| miR395 target | ATP sulfurylase domain protein | 1722 | MRT3702__57141C.1 | 331-350 | Arabidopsis thaliana | |
| miR395 target | ATP sulfurylase domain protein | 1723 | MRT3708__36129C.1 | 403-422 | Brassica napus | |
| miR395 target | ATP sulfurylase domain protein | 1724 | MRT3708__4492C.1 | 316-335 | Brassica napus | |
| miR395 target | ATP sulfurylase domain protein | 1725 | MRT3708__55043C.1 | 400-419 | Brassica napus | |
| miR395 target | ATP sulfurylase domain protein | 1726 | MRT3711__3394C.1 | 356-375 | Brassica rapa | |
| miR395 target | ATP sulfurylase domain protein | 1727 | MRT3711__4165C.1 | 383-402 | Brassica rapa | |
| miR395 target | ATP sulfurylase domain protein | 1728 | MRT3711__4313C.1 | 384-403 | Brassica rapa | |

TABLE 3-continued

| Construct type | Name | SEQ ID NO: | Gene ID | Nucleotide Position | Source Organism | Rationale for plant transformation* |
|---|---|---|---|---|---|---|
| miR395 target | Sulfate transporter | 1729 | MRT3712__1686C.1 | 124-143 | Brassica oleracea | |
| miR395 target | Sulfate transporter | 1730 | MRT3847__10451C.5 | 125-144 | Glycine max | |
| miR395 target | Sulfate transporter | 1731 | MRT3847__131987C.4 | 153-172 | Glycine max | |
| miR395 target | ATP sulfurylase domain protein | 1732 | MRT3847__14792C.7 | 641-660 | Glycine max | |
| miR395 target | Sulfate transporter | 1733 | MRT3847__245035C.3 | 64-83 | Glycine max | |
| miR395 target | ATP sulfurylase domain protein | 1734 | MRT3847__331787C.1 | 381-400 | Glycine max | |
| miR395 target | ATP sulfurylase domain protein | 1735 | MRT4530__16384C.4 | 560-579 | Oryza sativa | |
| miR395 target | Sulfate transporter | 1736 | MRT4530__33633C.6 | 746-765 | Oryza sativa | |
| miR395 target | ATP sulfurylase domain protein | 1737 | MRT4558__11861C.1 | 474-493 | Sorghum bicolor | |
| miR395 target | Sulfate transporter | 1738 | MRT4558__24400C.2 | 275-294 | Sorghum bicolor | |
| miR395 target | Sulfate transporter | 1739 | MRT4565__219452C.1 | 259-278 | Triticum aestivum | |
| miR395 target | ATP sulfurylase domain protein | 1740 | MRT4565__223839C.1 | 541-560 | Triticum aestivum | |
| miR395 target | ATP sulfurylase domain protein | 1741 | MRT4565__232080C.1 | 462-481 | Triticum aestivum | |
| miR395 target | ATP sulfurylase domain protein | 1742 | MRT4565__236093C.1 | 542-561 | Triticum aestivum | |
| miR395 target | ATP sulfurylase domain protein | 1743 | MRT4565__254783C.1 | 482-501 | Triticum aestivum | |
| miR395 target | miR395 target | 1744 | MRT4565__35429C.3 | 207-226 | Triticum aestivum | |
| miR395 target | ATP sulfurylase domain protein | 1745 | MRT4577__118322C.5 | 455-474 | Zea mays | |
| miR395 target | ATP sulfurylase domain protein | 1746 | MRT4577__386324C.4 | 465-484 | Zea mays | |
| miR395 target | ATP sulfurylase domain protein | 1747 | MRT4577__57434C.9 | 528-547 | Zea mays | |
| miR395 target | miR395 target | 1748 | MRT4577__644561C.1 | 27-46 | Zea mays | |
| miR395 target | miR395 target | 1749 | MRT4577__694623C.1 | 449-468 | Zea mays | |
| miRNA | miR398 | 1750 | | | Zea mays | |
| miR398 target | SODs and cytochrome c oxidase | 1751 | | | Zea mays | |
| Decoy | miR398 decoy | 1752 | | | Artificial sequence | Improved yield* |
| Decoy | miR398 decoy | 1753 | | | Artificial sequence | Improved yield* |
| miR398 target | miR398 target | 1754 | MRT3702__118804C.3 | 1651-1671 | Arabidopsis thaliana | |
| miR398 target | Copper/zinc superoxide dismutase (SODC) domain protein | 1755 | MRT3708__22683C.2 | 117-137 | Brassica napus | |
| miR398 target | Las1-like | 1756 | MRT3847__22858C.5 | 2306-2326 | Glycine max | |
| miR398 target | Copper/zinc superoxide dismutase (SODC) domain protein | 1757 | MRT3847__235546C.3 | 112-132 | Glycine max | |
| miR398 target | Copper/zinc superoxide dismutase (SODC) domain protein | 1758 | MRT4530__151653C.4 | 66-86 | Oryza sativa | |
| miR398 target | miR398 target | 1759 | MRT4530__201873C.4 | 1720-1740 | Oryza sativa | |
| miR398 target | Copper/zinc superoxide dismutase (SODC) domain protein | 1760 | MRT4530__20521C.4 | 152-172 | Oryza sativa | |
| miR398 target | Copper/zinc superoxide dismutase (SODC) domain protein | 1761 | MRT4558__3896C.2 | 103-123 | Sorghum bicolor | |
| miR398 target | Copper/zinc superoxide dismutase (SODC) domain protein | 1762 | MRT4558__9962C.2 | 176-196 | Sorghum bicolor | |
| miR398 target | miR398 target | 1763 | MRT4565__118267C.1 | 66-86 | Triticum aestivum | |
| miR398 target | miR398 target | 1764 | MRT4565__122618C.1 | 14-34 | Triticum aestivum | |
| miR398 target | Copper/zinc superoxide dismutase (SODC) domain protein | 1765 | MRT4565__123037C.3 | 94-114 | Triticum aestivum | |
| miR398 target | miR398 target | 1766 | MRT4565__129871C.1 | 54-74 | Triticum aestivum | |

TABLE 3-continued

| Construct type | Name | SEQ ID NO: | Gene ID | Nucleotide Position | Source Organism | Rationale for plant transformation* |
|---|---|---|---|---|---|---|
| miR398 target | Copper/zinc superoxide dismutase (SODC) domain protein | 1767 | MRT4565__133338C.1 | 172-192 | Triticum aestivum | |
| miR398 target | Copper/zinc superoxide dismutase (SODC) domain protein | 1768 | MRT4565__162003C.1 | 144-164 | Triticum aestivum | |
| miR398 target | miR398 target | 1769 | MRT4565__16358C.1 | 66-86 | Triticum aestivum | |
| miR398 target | miR398 target | 1770 | MRT4565__187852C.1 | 194-214 | Triticum aestivum | |
| miR398 target | Copper/zinc superoxide dismutase (SODC) domain protein | 1771 | MRT4565__201143C.1 | 93-113 | Triticum aestivum | |
| miR398 target | Copper/zinc superoxide dismutase (SODC) domain protein | 1772 | MRT4565__201144C.1 | 85-105 | Triticum aestivum | |
| miR398 target | Cytochrome c oxidase subunit Vb | 1773 | MRT4565__221067C.1 | 153-173 | Triticum aestivum | |
| miR398 target | Cytochrome c oxidase subunit Vb | 1774 | MRT4565__223829C.1 | 139-159 | Triticum aestivum | |
| miR398 target | Cytochrome c oxidase subunit Vb | 1775 | MRT4565__230710C.1 | 303-323 | Triticum aestivum | |
| miR398 target | Copper/zinc superoxide dismutase (SODC) domain protein | 1776 | MRT4565__236346C.1 | 91-111 | Triticum aestivum | |
| miR398 target | Copper/zinc superoxide dismutase (SODC) domain protein | 1777 | MRT4565__244294C.1 | 69-89 | Triticum aestivum | |
| miR398 target | Cytochrome c oxidase subunit Vb | 1778 | MRT4565__246005C.1 | 160-180 | Triticum aestivum | |
| miR398 target | Copper/zinc superoxide dismutase (SODC) domain protein | 1779 | MRT4565__248858C.1 | 69-89 | Triticum aestivum | |
| miR398 target | Copper/zinc superoxide dismutase (SODC) domain protein | 1780 | MRT4565__72209C.2 | 105-125 | Triticum aestivum | |
| miR398 target | Copper/zinc superoxide dismutase (SODC) domain protein | 1781 | MRT4577__19020C.8 | 92-112 | Zea mays | |
| miR398 target | Copper/zinc superoxide dismutase (SODC) domain protein | 1782 | MRT4577__211709C.6 | 85-105 | Zea mays | |
| miR398 target | Copper/zinc superoxide dismutase (SODC) domain protein | 1783 | MRT4577__329847C.3 | 89-109 | Zea mays | |
| miR398 target | Copper/zinc superoxide dismutase (SODC) domain protein | 1784 | MRT4577__329851C.4 | 114-134 | Zea mays | |
| miR398 target | Copper/zinc superoxide dismutase (SODC) domain protein | 1785 | MRT4577__335011C.2 | 7-27 | Zea mays | |
| miR398 target | Copper/zinc superoxide dismutase (SODC) domain protein | 1786 | MRT4577__339810C.4 | 174-194 | Zea mays | |
| miR398 target | Copper/zinc superoxide dismutase (SODC) domain protein | 1787 | MRT4577__339813C.4 | 233-253 | Zea mays | |
| miR398 target | Copper/zinc superoxide dismutase (SODC) domain protein | 1788 | MRT4577__358061C.1 | 120-140 | Zea mays | |
| miR398 target | Copper/zinc superoxide dismutase (SODC) domain protein | 1789 | MRT4577__388896C.4 | 200-220 | Zea mays | |
| miR398 target | Copper/zinc superoxide dismutase (SODC) domain protein | 1790 | MRT4577__401904C.1 | 49-69 | Zea mays | |
| miR398 target | Copper/zinc superoxide dismutase (SODC) domain protein | 1791 | MRT4577__54564C.7 | 147-167 | Zea mays | |
| miR398 target | miR398 target | 1792 | MRT4577__561629C.1 | 222-242 | Zea mays | |
| miR398 target | miR398 target | 1793 | MRT4577__570532C.1 | 129-149 | Zea mays | |
| miR398 target | Copper/zinc superoxide dismutase (SODC) domain protein | 1794 | MRT4577__571443C.1 | 184-204 | Zea mays | |
| miR398 target | miR398 target | 1795 | MRT4577__648609C.1 | 83-103 | Zea mays | |
| miRNA | miR399 | 1796 | | | Zea mays | |

TABLE 3-continued

| Construct type | Name | SEQ ID NO: | Gene ID | Nucleotide Position | Source Organism | Rationale for plant transformation* |
|---|---|---|---|---|---|---|
| miRNA | miR399 | 1797 | | | Zea mays | |
| miRNA | miR399 | 1798 | | | Zea mays | |
| miRNA | miR399 | 1799 | | | Zea mays | |
| miR399 target | pho2 and inorganic phosphate transporter | 1800 | | | Zea mays | |
| Decoy | miR399 decoy | 1801 | | | Artificial sequence | Improved yield* |
| Cleavage blocker | miR399 cleavage blocker (in miRMON1 backbone) | 1802 | | | Artificial sequence | Improved yield* |
| miR399 target | E2, ubiquitin-conjugating enzyme; At2g33770 PHO2 | 1803 | MRT3702__9137C.7 | 607-627 | Arabidopsis thaliana | |
| miR399 target | PHO2-like (phosphate) E2 ubiquitin-conjugating enzyme | 1804 | MRT3847__4521C.5 | 139-159 | Glycine max | |
| miR399 target | Phosphate transporter | 1805 | MRT3847__51499C.6 | 381-401 | Glycine max | |
| miR399 target | PHO2-like (phosphate) E2 ubiquitin-conjugating enzyme | 1806 | MRT3880__39637C.1 | 33-53 | Medicago truncatula | |
| miR399 target | miR399 target | 1807 | MRT3880__45031C.1 | 512-532 | Medicago truncatula | |
| miR399 target | miR399 target | 1808 | MRT3880__48872C.1 | 5-25 | Medicago truncatula | |
| miR399 target | miR399 target | 1809 | MRT3880__54972C.1 | 5-25 | Medicago truncatula | |
| miR399 target | Phosphate transporter | 1810 | MRT3880__64645C.1 | 245-265 | Medicago truncatula | |
| miR399 target | miR399 target | 1811 | MRT4530__189375C.1 | 502-522 | Oryza sativa | |
| miR399 target | Phosphate transporter | 1812 | MRT4530__40506C.4 | 292-312 | Oryza sativa | |
| miR399 target | miR399 target | 1813 | MRT4530__53090C.4 | 821-841 | Oryza sativa | |
| miR399 target | miR399 target | 1814 | MRT4530__7904C.4 | 1144-1164 | Oryza sativa | |
| miR399 target | miR399 target | 1815 | MRT4558__16475C.1 | 693-713 | Sorghum bicolor | |
| miR399 target | miR399 target | 1816 | MRT4558__34625C.1 | 171-191 | Sorghum bicolor | |
| miR399 target | miR399 target | 1817 | MRT4565__160343C.1 | 481-501 | Triticum aestivum | |
| miRNA | miR408 | 1818 | | | Zea mays | |
| miR408 target | laccase and plantacyanin | 1819 | | | Zea mays | |
| Decoy | miR408 decoy | 1820 | | | Artificial sequence | Improved yield* |
| miR408 target | Laccase (Diphenol oxidase); Multicopper oxidase Plantacyanin | 1821 | MRT3635__36078C.2 | 61-80 | Gossypium hirsutum | |
| miR408 target | Laccase (Diphenol oxidase); Multicopper oxidase Plantacyanin | 1822 | MRT3635__36080C.2 | 61-80 | Gossypium hirsutum | |
| miR408 target | Laccase (Diphenol oxidase); Multicopper oxidase Plantacyanin | 1823 | MRT3702__153631C.1 | 42-61 | Arabidopsis thaliana | |
| miR408 target | Laccase (Diphenol oxidase); Multicopper oxidase Plantacyanin | 1824 | MRT3702__20027C.5 | 108-127 | Arabidopsis thaliana | |
| miR408 target | Laccase (Diphenol oxidase); Multicopper oxidase Plantacyanin | 1825 | MRT3702__20202C.5 | 99-118 | Arabidopsis thaliana | |
| miR408 target | Laccase (Diphenol oxidase); Multicopper oxidase Plantacyanin | 1826 | MRT3702__6668C.5 | 71-90 | Arabidopsis thaliana | |
| miR408 target | miR408 target | 1827 | MRT3708__48434C.2 | 137-156 | Brassica napus | |
| miR408 target | Laccase (Diphenol oxidase); Multicopper oxidase Plantacyanin | 1828 | MRT3711__7108C.1 | 9-28 | Brassica rapa | |
| miR408 target | miR408 target | 1829 | MRT3847__133008C.1 | 25-44 | Glycine max | |
| miR408 target | miR408 target | 1830 | MRT3847__166855C.1 | 17-36 | Glycine max | |
| miR408 target | Laccase (Diphenol oxidase); Multicopper oxidase Plantacyanin | 1831 | MRT3847__261984C.4 | 181-200 | Glycine max | |

TABLE 3-continued

| Construct type | Name | SEQ ID NO: | Gene ID | Nucleotide Position | Source Organism | Rationale for plant transformation* |
|---|---|---|---|---|---|---|
| miR408 target | Laccase (Diphenol oxidase); Multicopper oxidase Plantacyanin | 1832 | MRT3847__273040C.3 | 702-721 | Glycine max | |
| miR408 target | miR408 target | 1833 | MRT3847__273288C.3 | 114-133 | Glycine max | |
| miR408 target | Laccase (Diphenol oxidase); Multicopper oxidase Plantacyanin | 1834 | MRT3847__296270C.2 | 189-208 | Glycine max | |
| miR408 target | miR408 target | 1835 | MRT3847__31127C.7 | 232-251 | Glycine max | |
| miR408 target | miR408 target | 1836 | MRT3847__329905C.2 | 137-156 | Glycine max | |
| miR408 target | miR408 target | 1837 | MRT3847__336704C.1 | 58-77 | Glycine max | |
| miR408 target | miR408 target | 1838 | MRT3847__343250C.1 | 286-305 | Glycine max | |
| miR408 target | miR408 target | 1839 | MRT3847__346770C.1 | 38-57 | Glycine max | |
| miR408 target | miR408 target | 1840 | MRT3847__349900C.1 | 68-87 | Glycine max | |
| miR408 target | miR408 target | 1841 | MRT3847__66506C.8 | 33-52 | Glycine max | |
| miR408 target | miR408 target | 1842 | MRT3847__66508C.1 | 12-31 | Glycine max | |
| miR408 target | miR408 target | 1843 | MRT3880__52991C.2 | 96-115 | Medicago truncatula | |
| miR408 target | Laccase (Diphenol oxidase); Multicopper oxidase Plantacyanin | 1844 | MRT3880__53025C.1 | 96-115 | Medicago truncatula | |
| miR408 target | Laccase (Diphenol oxidase); Multicopper oxidase Plantacyanin | 1845 | MRT3880__58299C.2 | 659-678 | Medicago truncatula | |
| miR408 target | Laccase (Diphenol oxidase); Multicopper oxidase Plantacyanin | 1846 | MRT3880__5838C.1 | 37-56 | Medicago truncatula | |
| miR408 target | Laccase (Diphenol oxidase); Multicopper oxidase Plantacyanin | 1847 | MRT3880__61178C.1 | 715-734 | Medicago truncatula | |
| miR408 target | miR408 target | 1848 | MRT4513__31098C.2 | 106-125 | Hordeum vulgare | |
| miR408 target | Laccase (Diphenol oxidase); Multicopper oxidase Plantacyanin | 1849 | MRT4513__36864C.1 | 93-112 | Hordeum vulgare | |
| miR408 target | Laccase (Diphenol oxidase); Multicopper oxidase Plantacyanin | 1850 | MRT4513__43046C.1 | 113-132 | Hordeum vulgare | |
| miR408 target | Laccase (Diphenol oxidase); Multicopper oxidase Plantacyanin | 1851 | MRT4513__47240C.1 | 630-649 | Hordeum vulgare | |
| miR408 target | Laccase (Diphenol oxidase); Multicopper oxidase Plantacyanin | 1852 | MRT4513__8677C.1 | 71-90 | Hordeum vulgare | |
| miR408 target | Laccase (Diphenol oxidase); Multicopper oxidase Plantacyanin | 1853 | MRT4530__137979C.3 | 929-948 | Oryza sativa | |
| miR408 target | miR408 target | 1854 | MRT4530__148564C.5 | 1091-1110 | Oryza sativa | |
| miR408 target | Laccase (Diphenol oxidase); Multicopper oxidase Plantacyanin | 1855 | MRT4530__160612C.2 | 220-239 | Oryza sativa | |
| miR408 target | Laccase (Diphenol oxidase); Multicopper oxidase Plantacyanin | 1856 | MRT4530__169405C.1 | 105-124 | Oryza sativa | |
| miR408 target | miR408 target | 1857 | MRT4530__247839C.2 | 360-379 | Oryza sativa | |
| miR408 target | Laccase (Diphenol oxidase); Multicopper oxidase Plantacyanin | 1858 | MRT4530__260849C.1 | 658-677 | Oryza sativa | |
| miR408 target | Laccase (Diphenol oxidase); Multicopper oxidase Plantacyanin | 1859 | MRT4530__26787C.5 | 611-630 | Oryza sativa | |
| miR408 target | miR408 target | 1860 | MRT4530__274369C.1 | 112-131 | Oryza sativa | |
| miR408 target | miR408 target | 1861 | MRT4530__275579C.1 | 108-127 | Oryza sativa | |
| miR408 target | miR408 target | 1862 | MRT4530__36958C.6 | 99-118 | Oryza sativa | |
| miR408 target | Laccase (Diphenol oxidase); Multicopper oxidase Plantacyanin | 1863 | MRT4530__40477C.6 | 182-201 | Oryza sativa | |
| miR408 target | Laccase (Diphenol oxidase); Multicopper oxidase Plantacyanin | 1864 | MRT4530__69716C.6 | 162-181 | Oryza sativa | |
| miR408 target | miR408 target | 1865 | MRT4558__23167C.3 | 713-732 | Sorghum bicolor | |

TABLE 3-continued

| Construct type | Name | SEQ ID NO: | Gene ID | Nucleotide Position | Source Organism | Rationale for plant transformation* |
|---|---|---|---|---|---|---|
| miR408 target | Laccase (Diphenol oxidase); Multicopper oxidase Plantacyanin | 1866 | MRT4558__2496C.2 | 104-123 | Sorghum bicolor | |
| miR408 target | Laccase (Diphenol oxidase); Multicopper oxidase Plantacyanin | 1867 | MRT4558__26802C.1 | 87-106 | Sorghum bicolor | |
| miR408 target | Laccase (Diphenol oxidase); Multicopper oxidase Plantacyanin | 1868 | MRT4558__37109C.1 | 109-128 | Sorghum bicolor | |
| miR408 target | Laccase (Diphenol oxidase); Multicopper oxidase Plantacyanin | 1869 | MRT4558__40844C.1 | 217-236 | Sorghum bicolor | |
| miR408 target | Laccase (Diphenol oxidase); Multicopper oxidase Plantacyanin | 1870 | MRT4558__5019C.2 | 102-121 | Sorghum bicolor | |
| miR408 target | Laccase (Diphenol oxidase); Multicopper oxidase Plantacyanin | 1871 | MRT4558__8981C.2 | 180-199 | Sorghum bicolor | |
| miR408 target | Laccase (Diphenol oxidase); Multicopper oxidase Plantacyanin | 1872 | MRT4565__100542C.3 | 91-110 | Triticum aestivum | |
| miR408 target | Laccase (Diphenol oxidase); Multicopper oxidase Plantacyanin | 1873 | MRT4565__130135C.1 | 10-29 | Triticum aestivum | |
| miR408 target | Hsp70 domain protein | 1874 | MRT4565__198220C.1 | 1221-1240 | Triticum aestivum | |
| miR408 target | miR408 target | 1875 | MRT4565__202586C.1 | 51-70 | Triticum aestivum | |
| miR408 target | Laccase (Diphenol oxidase); Multicopper oxidase Plantacyanin | 1876 | MRT4565__216408C.1 | 206-225 | Triticum aestivum | |
| miR408 target | Ammonium transporter; basic helix-loop-helix domain (bHLH) | 1877 | MRT4565__219732C.1 | 742-761 | Triticum aestivum | |
| miR408 target | Laccase (Diphenol oxidase); Multicopper oxidase Plantacyanin | 1878 | MRT4565__229783C.1 | 98-117 | Triticum aestivum | |
| miR408 target | Laccase (Diphenol oxidase); Multicopper oxidase Plantacyanin | 1879 | MRT4565__235378C.1 | 116-135 | Triticum aestivum | |
| miR408 target | Laccase (Diphenol oxidase); Multicopper oxidase Plantacyanin | 1880 | MRT4565__250808C.1 | 652-671 | Triticum aestivum | |
| miR408 target | Laccase (Diphenol oxidase); Multicopper oxidase Plantacyanin | 1881 | MRT4565__257176C.1 | 91-110 | Triticum aestivum | |
| miR408 target | Laccase (Diphenol oxidase); Multicopper oxidase Plantacyanin | 1882 | MRT4565__263239C.1 | 102-121 | Triticum aestivum | |
| miR408 target | Laccase (Diphenol oxidase); Multicopper oxidase Plantacyanin | 1883 | MRT4565__263949C.1 | 94-113 | Triticum aestivum | |
| miR408 target | miR408 target | 1884 | MRT4565__267955C.1 | 84-103 | Triticum aestivum | |
| miR408 target | Laccase (Diphenol oxidase); Multicopper oxidase Plantacyanin | 1885 | MRT4565__274907C.1 | 720-739 | Triticum aestivum | |
| miR408 target | Laccase (Diphenol oxidase); Multicopper oxidase Plantacyanin | 1886 | MRT4565__276632C.1 | 172-191 | Triticum aestivum | |
| miR408 target | miR408 target | 1887 | MRT4565__278866C.1 | 365-384 | Triticum aestivum | |
| miR408 target | Laccase (Diphenol oxidase); Multicopper oxidase Plantacyanin | 1888 | MRT4565__66211C.2 | 36-55 | Triticum aestivum | |
| miR408 target | Laccase (Diphenol oxidase); Multicopper oxidase Plantacyanin | 1889 | MRT4565__67059C.3 | 133-152 | Triticum aestivum | |
| miR408 target | Laccase (Diphenol oxidase); Multicopper oxidase Plantacyanin | 1890 | MRT4565__87146C.2 | 314-333 | Triticum aestivum | |
| miR408 target | Laccase (Diphenol oxidase); Multicopper oxidase Plantacyanin | 1891 | MRT4577__137208C.1 | 94-113 | Zea mays | |

TABLE 3-continued

| Construct type | Name | SEQ ID NO: | Gene ID | Nucleotide Position | Source Organism | Rationale for plant transformation* |
|---|---|---|---|---|---|---|
| miR408 target | miR408 target | 1892 | MRT4577__191445C.5 | 696-715 | Zea mays | |
| miR408 target | miR408 target | 1893 | MRT4577__234909C.4 | 331-350 | Zea mays | |
| miR408 target | miR408 target | 1894 | MRT4577__245033C.8 | 117-136 | Zea mays | |
| miR408 target | Laccase (Diphenol oxidase); Multicopper oxidase Plantacyanin | 1895 | MRT4577__264839C.3 | 102-121 | Zea mays | |
| miR408 target | miR408 target | 1896 | MRT4577__30771C.9 | 282-301 | Zea mays | |
| miR408 target | miR408 target | 1897 | MRT4577__325201C.6 | 619-638 | Zea mays | |
| miR408 target | Laccase (Diphenol oxidase); Multicopper oxidase Plantacyanin | 1898 | MRT4577__325458C.1 | 59-78 | Zea mays | |
| miR408 target | Laccase (Diphenol oxidase); Multicopper oxidase Plantacyanin | 1899 | MRT4577__327865C.2 | 113-132 | Zea mays | |
| miR408 target | miR408 target | 1900 | MRT4577__341887C.5 | 132-151 | Zea mays | |
| miR408 target | miR408 target | 1901 | MRT4577__37590C.9 | 800-819 | Zea mays | |
| miR408 target | miR408 target | 1902 | MRT4577__380413C.6 | 208-227 | Zea mays | |
| miR408 target | miR408 target | 1903 | MRT4577__387021C.4 | 151-170 | Zea mays | |
| miR408 target | miR408 target | 1904 | MRT4577__388860C.4 | 117-136 | Zea mays | |
| miR408 target | miR408 target | 1905 | MRT4577__427804C.4 | 729-748 | Zea mays | |
| miR408 target | Laccase (Diphenol oxidase); Multicopper oxidase Plantacyanin | 1906 | MRT4577__446604C.1 | 67-86 | Zea mays | |
| miR408 target | miR408 target | 1907 | MRT4577__456053C.1 | 66-85 | Zea mays | |
| miR408 target | miR408 target | 1908 | MRT4577__461451C.3 | 463-482 | Zea mays | |
| miR408 target | miR408 target | 1909 | MRT4577__46308C.7 | 273-292 | Zea mays | |
| miR408 target | Laccase (Diphenol oxidase); Multicopper oxidase Plantacyanin | 1910 | MRT4577__517561C.1 | 883-902 | Zea mays | |
| miR408 target | Laccase (Diphenol oxidase); Multicopper oxidase Plantacyanin | 1911 | MRT4577__528699C.2 | 636-655 | Zea mays | |
| miR408 target | miR408 target | 1912 | MRT4577__536494C.2 | 151-170 | Zea mays | |
| miR408 target | Laccase (Diphenol oxidase); Multicopper oxidase Plantacyanin | 1913 | MRT4577__550892C.1 | 659-678 | Zea mays | |
| miR408 target | miR408 target | 1914 | MRT4577__572693C.1 | 101-120 | Zea mays | |
| miR408 target | miR408 target | 1915 | MRT4577__602288C.1 | 5-24 | Zea mays | |
| miR408 target | miR408 target | 1916 | MRT4577__603948C.1 | 206-225 | Zea mays | |
| miR408 target | miR408 target | 1917 | MRT4577__603999C.1 | 226-245 | Zea mays | |
| miR408 target | miR408 target | 1918 | MRT4577__610458C.1 | 111-130 | Zea mays | |
| miR408 target | miR408 target | 1919 | MRT4577__623809C.1 | 153-172 | Zea mays | |
| miR408 target | miR408 target | 1920 | MRT4577__625157C.1 | 254-273 | Zea mays | |
| miR408 target | miR408 target | 1921 | MRT4577__629379C.1 | 269-288 | Zea mays | |
| miR408 target | miR408 target | 1922 | MRT4577__645720C.1 | 236-255 | Zea mays | |
| miR408 target | miR408 target | 1923 | MRT4577__650403C.1 | 788-807 | Zea mays | |
| miR408 target | miR408 target | 1924 | MRT4577__686202C.1 | 160-179 | Zea mays | |
| miR408 target | miR408 target | 1925 | MRT4577__710942C.1 | 48-67 | Zea mays | |
| miR444 | miR444 | 1926 | | | Zea mays | |
| miRNA precursor | miR444 | 1927 | | | Zea mays | Improved yield* |
| miR444 target | Os.ANR1 | 1928 | | | Oryza sativa | |
| miRNA-unresponsive | Os.ANR1 (miR444 unresponsive) | 1929 | | | Artificial construct | Improved yield* |
| miR444 target | AGL17, AGL21, ANR1 | 1930 | | | Zea mays | |
| Decoy | miR444 decoy | 1931 | | | Artificial construct | Improved yield* |
| miR444 target | MADS-box transcription factor protein | 1932 | MRT3847__247970C.2 | 471-491 | Glycine max | |
| miR444 target | MADS-box transcription factor protein | 1933 | MRT3847__259952C.3 | 453-473 | Glycine max | |
| miR444 target | MADS-box transcription factor protein | 1934 | MRT3880__12754C.1 | 75-95 | Medicago truncatula | |
| miR444 target | miR444 target | 1935 | MRT4513__18691C.1 | 73-93 | Hordeum vulgare | |
| miR444 target | miR444 target | 1936 | MRT4513__36208C.1 | 320-340 | Hordeum vulgare | |
| miR444 target | miR444 target | 1937 | MRT4530__101813C.4 | 1164-1184 | Oryza sativa | |

TABLE 3-continued

| Construct type | Name | SEQ ID NO: | Gene ID | Nucleotide Position | Source Organism | Rationale for plant transformation* |
|---|---|---|---|---|---|---|
| miR444 target | MADS-box transcription factor protein | 1938 | MRT4530__196636C.3 | 539-559 | Oryza sativa | |
| miR444 target | miR444 target | 1939 | MRT4530__197829C.2 | 585-605 | Oryza sativa | |
| miR444 target | miR444 target | 1940 | MRT4530__223119C.3 | 610-630 | Oryza sativa | |
| miR444 target | miR444 target | 1941 | MRT4530__244375C.1 | 208-228 | Oryza sativa | |
| miR444 target | miR444 target | 1942 | MRT4530__251481C.2 | 1234-1254 | Oryza sativa | |
| miR444 target | miR444 target | 1943 | MRT4530__272160C.1 | 571-591 | Oryza sativa | |
| miR444 target | miR444 target | 1944 | MRT4530__274638C.1 | 337-357 | Oryza sativa | |
| miR444 target | miR444 target | 1945 | MRT4530__275771C.1 | 97-117 | Oryza sativa | |
| miR444 target | MADS-box transcription factor protein | 1946 | MRT4530__78475C.3 | 305-325 | Oryza sativa | |
| miR444 target | MADS-box transcription factor protein | 1947 | MRT4558__10090C.1 | 400-420 | Sorghum bicolor | |
| miR444 target | MADS-box transcription factor protein | 1948 | MRT4558__11440C.2 | 434-454 | Sorghum bicolor | |
| miR444 target | miR444 target | 1949 | MRT4558__3598C.3 | 1024-1044 | Sorghum bicolor | |
| miR444 target | miR444 target | 1950 | MRT4558__37372C.1 | 1355-1375 | Sorghum bicolor | |
| miR444 target | MADS-box transcription factor protein | 1951 | MRT4565__247066C.1 | 375-395 | Triticum aestivum | |
| miR444 target | MADS-box transcription factor protein | 1952 | MRT4565__39318C.3 | 416-436 | Triticum aestivum | |
| miR444 target | miR444 target | 1953 | MRT4565__98921C.1 | 352-372 | Triticum aestivum | |
| miR444 target | miR444 target | 1954 | MRT4577__166928C.8 | 1146-1166 | Zea mays | |
| miR444 target | miR444 target | 1955 | MRT4577__204116C.4 | 475-495 | Zea mays | |
| miR444 target | miR444 target | 1956 | MRT4577__296919C.6 | 475-495 | Zea mays | |
| miR444 target | MADS-box transcription factor protein | 1957 | MRT4577__321664C.4 | 1029-1049 | Zea mays | |
| miR444 target | miR444 target | 1958 | MRT4577__417091C.4 | 1757-1777 | Zea mays | |
| miR444 target | miR444 target | 1959 | MRT4577__502196C.3 | 468-488 | Zea mays | |
| miR444 target | miR444 target | 1960 | MRT4577__537511C.2 | 364-384 | Zea mays | |
| miR444 target | miR444 target | 1961 | MRT4577__538474C.2 | 451-471 | Zea mays | |
| miR444 target | miR444 target | 1962 | MRT4577__5433C.4 | 473-493 | Zea mays | |
| miR444 target | miR444 target | 1963 | MRT4577__543434C.2 | 377-397 | Zea mays | |
| miR444 target | MADS-box transcription factor protein | 1964 | MRT4577__553467C.1 | 17-37 | Zea mays | |
| miR444 target | miR444 target | 1965 | MRT4577__581326C.1 | 388-408 | Zea mays | |
| miR444 target | miR444 target | 1966 | MRT4577__590710C.1 | 509-529 | Zea mays | |
| miR444 target | miR444 target | 1967 | MRT4577__613242C.1 | 18-38 | Zea mays | |
| miR444 target | miR444 target | 1968 | MRT4577__672581C.1 | 430-450 | Zea mays | |
| miRNA | miR528 | 1969 | | | Zea mays | |
| miR528 target | SOD | 1970 | | | Zea mays | |
| Decoy | miR528 decoy | 1971 | | | Artificial construct | Improved yield* |
| miR528 target | Salicylic acid-binding protein | 1972 | MRT3847__26249C.5 | 98-118 | Glycine max | |
| miR528 target | Laccase (Diphenol oxidase); Multicopper oxidase Plantacyanin | 1973 | MRT4513__36138C.1 | 838-858 | Hordeum vulgare | |
| miR528 target | Laccase (Diphenol oxidase); Multicopper oxidase Plantacyanin | 1974 | MRT4513__39686C.1 | 35-55 | Hordeum vulgare | |
| miR528 target | Laccase (Diphenol oxidase); Multicopper oxidase Plantacyanin | 1975 | MRT4513__5560C.1 | 506-525 | Hordeum vulgare | |
| miR528 target | Laccase (Diphenol oxidase); Multicopper oxidase Plantacyanin | 1976 | MRT4530__128077C.2 | 269-289 | Oryza sativa | |

TABLE 3-continued

| Construct type | Name | SEQ ID NO: | Gene ID | Nucleotide Position | Source Organism | Rationale for plant transformation* |
|---|---|---|---|---|---|---|
| miR528 target | Laccase (Diphenol oxidase); Multicopper oxidase Plantacyanin | 1977 | MRT4530__139238C.4 | 2152-2172 | Oryza sativa | |
| miR528 target | Laccase (Diphenol oxidase); Multicopper oxidase Plantacyanin | 1978 | MRT4530__155994C.3 | 247-267 | Oryza sativa | |
| miR528 target | VIP2-like protein; PHD-zinc finger | 1979 | MRT4530__237311C.1 | 632-652 | Oryza sativa | |
| miR528 target | Laccase (Diphenol oxidase); Multicopper oxidase Plantacyanin | 1980 | MRT4530__275240C.1 | 24-44 | Oryza sativa | |
| miR528 target | Laccase (Diphenol oxidase); Multicopper oxidase Plantacyanin | 1981 | MRT4530__68465C.5 | 687-706 | Oryza sativa | |
| miR528 target | VIP2-like protein; PHD-zinc finger | 1982 | MRT4530__85016C.5 | 215-235 | Oryza sativa | |
| miR528 target | Laccase (Diphenol oxidase); Multicopper oxidase Plantacyanin | 1983 | MRT4558__8881C.1 | 101-121 | Sorghum bicolor | |
| miR528 target | Laccase (Diphenol oxidase); Multicopper oxidase Plantacyanin | 1984 | MRT4565__204482C.1 | 212-231 | Triticum aestivum | |
| miR528 target | Laccase (Diphenol oxidase); Multicopper oxidase Plantacyanin | 1985 | MRT4565__219247C.1 | 923-943 | Triticum aestivum | |
| miR528 target | Laccase (Diphenol oxidase); Multicopper oxidase Plantacyanin | 1986 | MRT4565__22497C.4 | 806-826 | Triticum aestivum | |
| miR528 target | Major Facilitator Superfamily | 1987 | MRT4565__260315C.1 | 584-604 | Triticum aestivum | |
| miR528 target | Laccase (Diphenol oxidase); Multicopper oxidase Plantacyanin | 1988 | MRT4565__276632C.1 | 219-239 | Triticum aestivum | |
| miR528 target | miR528 target | 1989 | MRT4565__278866C.1 | 412-432 | Triticum aestivum | |
| miR528 target | Laccase (Diphenol oxidase); Multicopper oxidase Plantacyanin | 1990 | MRT4565__6214C.4 | 548-567 | Triticum aestivum | |
| miR528 target | Laccase (Diphenol oxidase); Multicopper oxidase Plantacyanin | 1991 | MRT4577__302078C.5 | 115-135 | Zea mays | |
| miR528 target | Laccase (Diphenol oxidase); Multicopper oxidase Plantacyanin | 1992 | MRT4577__327865C.2 | 163-183 | Zea mays | |
| miR528 target | Laccase (Diphenol oxidase); Multicopper oxidase Plantacyanin | 1993 | MRT4577__338803C.6 | 189-209 | Zea mays | |
| miR528 target | miR528 target | 1994 | MRT4577__574203C.1 | 48-68 | Zea mays | |
| miRNA | miR827 | 1995 | | | Zea mays | |
| miR827 target | SPX (SYG1/Pho81/XPR1) domain-containing protein; RING domain ubiquitin ligase | 1996 | MRT3702__118660C.4 | 258-278 | Arabidopsis thaliana | |
| miR827 target | SPX (SYG1/Pho81/XPR1) domain-containing protein; MFS_1: Major Facilitator Superfamily | 1997 | MRT3702__165543C.2 | 253-273 | Arabidopsis thaliana | |
| miR827 target | SPX (SYG1/Pho81/XPR1) domain-containing protein; MFS_1: Major Facilitator Superfamily | 1998 | MRT3702__4781C.6 | 153-173 | Arabidopsis thaliana | |
| miR827 target | SPX (SYG1/Pho81/XPR1) domain-containing protein; RING domain ubiquitin ligase | 1999 | MRT3708__29390C.1 | 32-52 | Brassica napus | |
| miR827 target | miR827 target | 2000 | MRT3711__10064C.1 | 155-175 | Brassica rapa | |
| miR827 target | SPX (SYG1/Pho81/XPR1) domain-containing protein | 2001 | MRT3712__6456C.1 | 96-116 | Brassica oleracea | |

TABLE 3-continued

| Construct type | Name | SEQ ID NO: | Gene ID | Nucleotide Position | Source Organism | Rationale for plant transformation* |
|---|---|---|---|---|---|---|
| miR827 target | SPX (SYG1/Pho81/XPR1) domain-containing protein; MFS_1: Major Facilitator Superfamily | 2002 | MRT4530__236774C.2 | 395-415 | Oryza sativa | |
| miR827 target | SPX (SYG1/Pho81/XPR1) domain-containing protein; MFS_1: Major Facilitator Superfamily | 2003 | MRT4530__45193C.6 | 335-355 | Oryza sativa | |
| miR827 target | miR827 target | 2004 | MRT4577__197256C.1 | 135-155 | Zea mays | |
| miR827 target | miR827 target | 2005 | MRT4577__235663C.3 | 559-579 | Zea mays | |
| miRNA | miRCOP1__1227-1247 | 2006 | | | Artificial sequence | Improved yield* |
| miRNA | miRCOP1__653-673 | 2007 | | | Artificial sequence | Improved yield* |
| miRNA | miRCOP1__1417-1437 | 2008 | | | Artificial sequence | Improved yield* |
| miRCOP1 target | COP1 (constitutive photomorphogenesis 1) | 2009 | | | Zea mays | |
| miRNA | miRGA2__945-965 | 2010 | | | Artificial sequence | Improved yield* |
| miRGA2 target | zm-GA2ox (gibberellic acid 2 oxidase) | 2011 | | | Zea mays | |
| miRNA | miRGA20__852-872 | 2012 | | | Artificial sequence | Improved yield* |
| miRGA20 target | zm-GA20ox (gibberellic acid 20 oxidase) | 2013 | | | Zea mays | |
| miRNA | miRHB2-4__700-720 | 2014 | | | Artificial sequence | Improved yield* |
| miRHB2-4 target | ZmHB2-4 (homeobox 2 and homeobox 4) | 2015 | | | Zea mays | |
| miRNA | miRHB4__84-104 | 2016 | | | Artificial sequence | Improved yield* |
| miRHB4 target | ZmHB-4 (homeobox 4) | 2017 | | | Zea mays | |
| miRNA | miRLG1__899-919 | 2018 | | | Artificial sequence | Improved yield* |
| miRLG1 target | LG1 (Liguleless1) | 2019 | | | Zea mays | |
| miRNA | miRMON18 | 2020 | | | Glycine max | |
| miRMON18 target | SPX (SYG1, PHO81 and XPR1 domain; PFAM entry PF03105 at www.sanger.ac.uk) | 2021 | | | Zea mays | |
| Decoy | miRMON18 decoy | 2022 | | | Artificial sequence | Improved yield* |
| miRNA precursor (synthetic) | miRVIM1a | 2023 | | | Artificial sequence | Improved yield* |
| miRVIM1a target | VIM1a (Variant in Methylation1a) | 2024 | | | Zea mays | |
| miRNA precursor (synthetic) | miRDHS1 | 2025 | | | Artificial sequence | Improved yield* |
| miRDHS1 target | DHS1 (Deoxyhypusine synthase) | 2026 | | | Zea mays | |
| miRNA precursor (synthetic) | miRDHS2 | 2027 | | | Artificial sequence | Improved yield* |
| miRDHS2 target | DHS2 (Deoxyhypusine synthase) | 2028 | | | Zea mays | |
| miRNA precursor (synthetic) | miRDHS3 | 2029 | | | Artificial sequence | Improved yield* |
| miRDHS3 target | DHS3 (Deoxyhypusine synthase) | 2030 | | | Zea mays | |
| miRNA precursor (synthetic) | miRDHS4 | 2031 | | | Artificial sequence | Improved yield* |
| miRDHS4 target | DHS4 (Deoxyhypusine synthase) | 2032 | | | Zea mays | |
| Synthetic tasiRNA | DHS5 ta-siRNA | 2033 | | | Artificial sequence | Improved yield* |
| DHS5 ta-siRNA target | DHS5 (Deoxyhypusine synthase) | 2034 | | | Zea mays | |

TABLE 3-continued

| Construct type | Name | SEQ ID NO: | Gene ID | Nucleotide Position | Source Organism | Rationale for plant transformation* |
|---|---|---|---|---|---|---|
| Synthetic tasiRNA | DHS6 ta-siRNA | 2035 | | | Artificial sequence | Improved yield* |
| DHS6 ta-siRNA target | DHS6 (Deoxyhypusine synthase) | 2036 | | | Zea mays | |
| Synthetic tasiRNA | DHS7 ta-siRNA | 2037 | | | Artificial sequence | Improved yield* |
| DHS7 ta-siRNA target | DHS7 (Deoxyhypusine synthase) | 2038 | | | Zea mays | |
| Synthetic tasiRNA | DHS8 ta-siRNA | 2039 | | | Artificial sequence | Improved yield* |
| DHS8 ta-siRNA target | DHS8 (Deoxyhypusine synthase) | 2040 | | | Zea mays | |
| Synthetic tasiRNA | DHS ta-siRNA | 2041 | | | Artificial sequence | Improved yield* |
| DHS ta-siRNA target | DHS (Deoxyhypusine synthase) | 2042 | | | Zea mays | |
| miRNA precursor (synthetic) | miRCRF_804-824 | 2043 | | | Artificial sequence | Improved yield* |
| miRCRF target | CRF (corn RING finger; also RNF169) | 2044 | | | Zea mays | |
| miRNA precursor | miRMON18 | 2045 | | | Zea mays | Improved yield* |
| miRMON18 target | SPX | 2046 | | | Zea mays | |
| miRNA precursor (synthetic) | miRZmG1543a | 2047 | | | Artificial sequence | Improved yield* |
| miRZmG1543a target | ZmG1543a (maize orthologue of Arabidopsis thaliana homeobox 17) | 2048 | | | Zea mays | |
| miRNA precursor (synthetic) | miRZmG1543 | 2049 | | | Artificial sequence | Improved yield* |
| miRZmG1543 target | ZmG1543a (maize orthologue of Arabidopsis thaliana homeobox 17) | 2050 | | | Zea mays | |
| miRNA precursor (synthetic) | miRZmG1543b | 2051 | | | Artificial sequence | Improved yield* |
| miRZmG1543b target | ZmG1543b (maize orthologue of Arabidopsis thaliana homeobox 17) | 2052 | | | Zea mays | |
| miRNA precursor (synthetic) | miRHB2 | 2053 | | | Artificial sequence | Improved yield* |
| miRHB2 target | HB2 (homeobox 2) | 2054 | | | Zea mays | |
| miRNA precursor | Os.MIR169g | 2055 | | | Oryza sativa | Improved yield* |
| miRNA precursor | Zm.MIR167g | 2056 | | | Artificial sequence | Improved yield* |
| miRNA precursor (synthetic) | miRGS3 | 2057 | | | Artificial sequence | Improved yield* |
| miRGS3 target | GS3 (grain size 3) | 2058 | | | Zea mays | |
| miRNA precursor (synthetic) | Zm_GW2_miR1 | 2059 | | | Artificial sequence | Improved yield* |
| miRNA precursor (synthetic) | Zm_GW2_miR2 | 2060 | | | Artificial sequence | Improved yield* |
| miRNA precursor (synthetic) | Zm_GW2_miR3 | 2061 | | | Artificial sequence | Improved yield* |
| GW2_miR1/2/3 target | GW2 (grain weight 2) | 2062 | | | Zea mays | |
| miRNA precursor (synthetic) | miR-IPS | 2063 | | | Artificial construct | Improved yield* |
| miR-IPS target | Zm_2-isopropylmalate synthase | 2064 | | | Zea mays | |

*Particularly preferred crop plants are maize, soybean, canola, cotton, alfalfa, sugarcane, sugar beet, *sorghum*, and rice

Example 5

This example illustrates various aspects of the invention relating to transgenic plant cells and transgenic plants. More specifically, this example illustrates transformation vectors and techniques useful with different crop plants for providing non-natural transgenic plant cells, plants, and seeds having in their genome any of this invention's recombinant DNA constructs transcribable in a plant cell, including a promoter that is functional in the plant cell and operably linked to at least one polynucleotide as disclosed herein, including: (1) a recombinant DNA construct transcribable in a plant cell, including a promoter that is functional in the plant cell and operably linked to at least one polynucleotide selected from: (a) DNA encoding a cleavage blocker to prevent or decrease small RNA-mediated cleavage of the transcript of at least one miRNA target identified in Tables 2 or 3; (b) DNA encoding a 5'-modified cleavage blocker to prevent or decrease small RNA-mediated cleavage of the transcript of at least one miRNA target identified in Tables 2 or 3; (c) DNA encoding a translational inhibitor to prevent or decrease small RNA-mediated cleavage of the transcript of at least one miRNA target identified in Tables 2 or 3; (d) DNA encoding a decoy to prevent or decrease small RNA-mediated cleavage of the transcript of at least one miRNA target identified in Tables 2 or 3; (e) DNA encoding a miRNA-unresponsive transgene having a nucleotide sequence derived from the native nucleotide sequence of at least one miRNA target identified in Tables 2 or 3, wherein a miRNA recognition site in the native nucleotide sequence is deleted or otherwise modified to prevent miRNA-mediated cleavage; (f) DNA encoding a miRNA precursor which is processed into a miRNA for suppressing expression of at least one miRNA target identified in Tables 2 or 3; (g) DNA encoding double-stranded RNA which is processed into siRNAs for suppressing expression of at least one miRNA target identified in Tables 2 or 3; and (h) DNA encoding a ta-siRNA which is processed into siRNAs for suppressing expression of at least one miRNA target identified in Tables 2 or 3; (2) a recombinant DNA construct transcribable in a plant cell, including a promoter that is functional in the plant cell and operably linked to at least one polynucleotide selected from: (a) DNA encoding a cleavage blocker to prevent or decrease small RNA-mediated cleavage of the transcript of at least one miRNA target; (b) DNA encoding a 5'-modified cleavage blocker to prevent or decrease small RNA-mediated cleavage of the transcript of at least one miRNA target; (c) DNA encoding a translational inhibitor to prevent or decrease small RNA-mediated cleavage of the transcript of at least one miRNA target; (d) DNA encoding a decoy to prevent or decrease small RNA-mediated cleavage of the transcript of at least one miRNA target; (e) DNA encoding a miRNA-unresponsive transgene having a nucleotide sequence derived from the native nucleotide sequence of at least one miRNA target, wherein a miRNA recognition site in the native nucleotide sequence is deleted or otherwise modified to prevent miRNA-mediated cleavage; (f) DNA encoding a miRNA precursor which is processed into a miRNA for suppressing expression of at least one miRNA target; (g) DNA encoding double-stranded RNA which is processed into siRNAs for suppressing expression of at least one miRNA target; and (h) DNA encoding a ta-siRNA which is processed into siRNAs for suppressing expression of at least one miRNA target—wherein the at least one miRNA target is at least one selected from the group consisting of a miR156 target, a miR160 target, a miR164 target, a miR166 target, a miR167 target, a miR169 target, a miR171 target, a miR172 target, a miR319 target, miR395 target, a miR396 target, a a miR398 target, a miR399 target, a miR408 target, a miR444 target, a miR528 target, a miR167g target, a miR169g target, COP1 (constitutive photomorphogenesis1), GA2ox (gibberellic acid 2 oxidase), GA20ox (gibberellic acid 20 oxidase), HB2 (homeobox 2), HB2-4 (homeobox 2 and homeobox 4), HB4 (homeobox 4), LG1 (liguleless1), SPX (SYG1, PHO81 and XPR1 domain; PFAM entry PF03105 at www(dot)sanger(dot)ac(dot)uk), VIM1a (variant in methlylation 1a), DHS1 (deoxyhypusine synthase), DHS2 (deoxyhypusine synthase), DHS3 (deoxyhypusine synthase), DHS4 (deoxyhypusine synthase), DHS5 (deoxyhypusine synthase), DHS6 (deoxyhypusine synthase), DHS7 (deoxyhypusine synthase), DHS8 (deoxyhypusine synthase), CRF (corn RING finger; RNF169), G1543a (maize orthologue of *Arabidopsis thaliana* homeobox 17), G1543b (maize orthologue of *Arabidopsis thaliana* homeobox 17), GS3 (grain size 3), and GW2 (grain weight 2); (3) a recombinant DNA construct transcribable in a plant cell, including a promoter that is functional in the plant cell and operably linked to at least one polynucleotide selected from the group consisting of DNA encoding a nucleotide sequence selected from SEQ ID NOs: 1120, 1121, 1122, 1248, 1257, 1313, 1314, 1364, 1387, 1478, 1489, 1490, 1491, 1492, 1493, 1585, 1597, 1598, 1599, 1713, 1752, 1753, 1801, 1802, 1820, 1927, 1929, 1931, 1971, 2006, 2007, 2008, 2010, 2012, 2014, 2016, 2018, 2022, 2023, 2025, 2027, 2029, 2031, 2033, 2035, 2037, 2039, 2041, 2043, 2045, 2047, 2049, 2051, 2053, 2055, 2056, 2057, 2059, 2060, 2061, and 2063; (4) a recombinant DNA construct transcribable in a plant cell, including a promoter functional in the non-natural transgenic plant cell and operably linked to at least one polynucleotide selected from DNA encoding at least one miRNA target identified in Tables 2 or 3; and (5) a recombinant DNA construct transcribable in a plant cell, including a promoter functional in the non-natural transgenic plant cell and operably linked to at least one polynucleotide including a DNA sequence selected from SEQ ID NOS: 15-2064). It is clear that the polynucleotide to be expressed using these recombinant DNA vectors in the non-natural transgenic plant cells, plants, and seeds can encode a transcript that prevents or decreases small RNA-mediated cleavage of the transcript of at least one miRNA target identified in Tables 2 or 3 (including the specific miRNA targets identified by name in this paragraph), or a transcript that suppresses expression of at least one miRNA target identified in Tables 2 or 3 (including the specific miRNA targets identified by name in this paragraph), or a transcript encoding at least one miRNA target identified in Tables 2 or 3, or encodes DNA sequence selected from SEQ ID NOS: 15-2064.

Transformation Vectors and Protocols

The following sections describe examples of a base vector for preparing transformation vectors including recombinant DNA constructs of this invention for transformation of a specific crop plant. The recombinant DNA constructs are transcribable in a plant cell and include a promoter that is functional in the plant cell and operably linked to at least one polynucleotide, which encodes a transcript that prevents or decreases small RNA-mediated cleavage of the transcript of at least one miRNA target identified in Tables 2 or 3 (including the specific miRNA targets identified by name in this paragraph), or a transcript that suppresses expression of at least one miRNA target identified in Tables 2 or 3 (including the specific miRNA targets identified by name in this paragraph), or a transcript encoding at least one miRNA target identified in Tables 2 or 3, or encodes DNA sequence selected from SEQ ID NOS: 15-2064. Also provided are detailed examples of crop-specific transformation protocols for using these vectors including recombinant DNA constructs of this invention to generate a non-natural transgenic plant cell, non-natural transgenic tissue, or non-natural transgenic plant. Additional transformation techniques are known to one of ordinary skill in the art, as reflected in the "Compendium of Transgenic Crop Plants", edited by Chittaranjan Kole and Timothy C. Hall, Blackwell Publishing Ltd., 2008; *ISBN* 978-1-405-16924-0 (available electronically at mrw(dot)interscience(dot)wiley(dot)com/emrw/9781405181099/hpt/toc). Such transformation methods are useful in producing a non-natural transgenic plant cell having a transformed nucleus. Non-natural transgenic plants, seeds, and pollen are subsequently produced from such a non-natural transgenic plant cell having a transformed nucleus, and screened for an enhanced trait (e.g., increased yield, enhanced water use efficiency, enhanced cold tolerance, enhanced nitrogen or phosphate use efficiency, enhanced seed protein, or enhanced seed oil, or any trait such as those disclosed above under the heading "Making and Using Transgenic Plant Cells and Transgenic Plants").

Transformation of Maize

Figure 2:
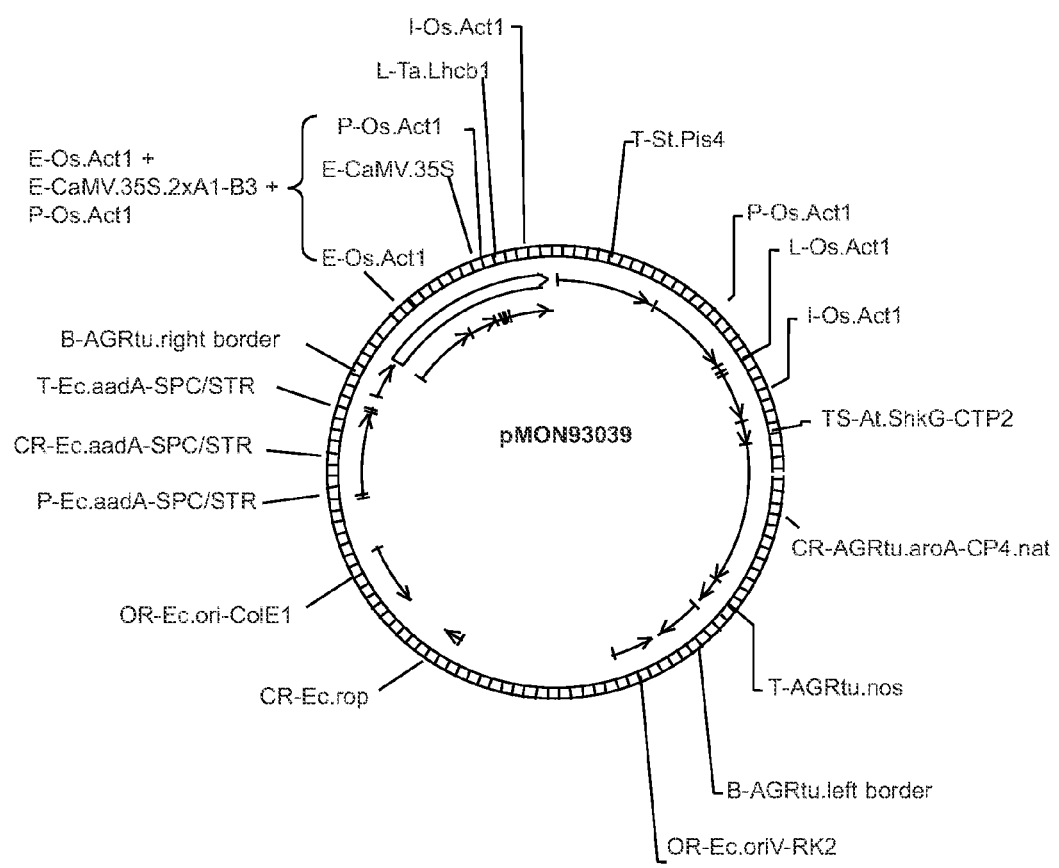
FIG. 2 depicts a maize transformation base vector (pMON93039, SEQ ID NO: 2065), as described in Example 5.

A base transformation vector pMON93039 (SEQ ID NO: 2065), illustrated in Table 4 and FIG. 2, is used in preparing recombinant DNA constructs for *Agrobacterium*-mediated transformation of maize cells. A transformation vector for expressing each of the recombinant DNA constructs of this invention is constructed by inserting a polynucleotide of this invention into the base vector pMON93039 (SEQ ID NO: 2065) in the gene of interest expression cassette at an insertion site, i.e., between the intron element (coordinates 1287-1766) and the polyadenylation element (coordinates 1838-2780). For example, a transformation vector for expression of a miR399 cleavage blocker is prepared by inserting the DNA of SEQ ID NO: 1802 (see Table 3) into the gene of interest expression cassette at an insertion site between the intron element (coordinates 1287-1766) and the polyadenylation element (coordinates 1838-2780) of pMON93039 (SEQ ID NO: 2065).

For *Agrobacterium*-mediated transformation of maize embryo cells, maize plants of a transformable line are grown in the greenhouse and ears are harvested when the embryos are 1.5 to 2.0 mm in length. Ears are surface sterilized by spraying or soaking the ears in 80% ethanol, followed by air drying. Immature embryos are isolated from individual kernels from sterilized ears. Prior to inoculation of maize cells, cultures of *Agrobacterium* each containing a transformation vector for expressing each of the recombinant DNA constructs of this invention are grown overnight at room temperature Immature maize embryo cells are inoculated with *Agrobacterium* after excision, incubated at room temperature with *Agrobacterium* for 5 to 20 minutes, and then co-cultured with *Agrobacterium* for 1 to 3 days at 23 degrees Celsius in the dark. Co-cultured embryos are transferred to a selection medium and cultured for approximately two weeks to allow embryogenic callus to develop. Embryogenic callus is transferred to a culture medium containing 100 mg/L paromomycin and subcultured at about two week intervals. Multiple events of transformed plant cells are recovered 6 to 8 weeks after initiation of selection.

Transgenic maize plants are regenerated from transgenic plant cell callus for each of the multiple transgenic events resulting from transformation and selection. The callus of transgenic plant cells of each event is placed on a medium to initiate shoot and root development into plantlets which are transferred to potting soil for initial growth in a growth chamber at 26 degrees Celsius, followed by growth on a mist bench before transplanting to pots where plants are grown to maturity. The regenerated plants are self-fertilized. First generation ("R1") seed is harvested. The seed or plants grown from the seed is used to select seeds, seedlings, progeny second generation ("R2") transgenic plants, or hybrids, e.g., by selecting transgenic plants exhibiting an enhanced trait as compared to a control plant (a plant lacking expression of the recombinant DNA construct).

The above process is repeated to produce multiple events of transgenic maize plant cells that are transformed with separate recombinant DNA constructs of this invention, i.e., a construct transcribable in a maize plant cell, including a promoter that is functional in the maize plant cell and operably linked to each polynucleotide selected from: (a) DNA encoding a cleavage blocker to prevent or decrease small RNA-mediated cleavage of the transcript of each miRNA target identified in Tables 2 and 3; (b) DNA encoding a 5'-modified cleavage blocker to prevent or decrease small RNA-mediated cleavage of the transcript of each miRNA target identified in Tables 2 and 3; (c) DNA encoding a translational inhibitor to prevent or decrease small RNA-mediated cleavage of the transcript of each miRNA target identified in Tables 2 and 3; (d) DNA encoding a decoy to prevent or decrease small RNA-mediated cleavage of the transcript of each miRNA target identified in Tables 2 and 3; (e) DNA encoding a miRNA-unresponsive transgene having a nucleotide sequence derived from the native nucleotide sequence of each miRNA target identified in Tables 2 and 3, wherein a miRNA recognition site in the native nucleotide sequence is deleted or otherwise modified to prevent miRNA-mediated cleavage; (f) DNA encoding a miRNA precursor which is processed into a miRNA for suppressing expression of each miRNA target identified in Tables 2 and 3; (g) DNA encoding double-stranded RNA which is processed into siRNAs for suppressing expression of each miRNA target identified in Tables 2 and 3; and (h) DNA encoding a ta-siRNA which is processed into siRNAs for suppressing expression of each miRNA target identified in Tables 2 and 3.

The above process is repeated to produce multiple events of transgenic maize plant cells that are transformed with each of the following recombinant DNA constructs of this invention, i.e., a construct transcribable in a maize plant cell, including a promoter that is functional in the maize plant cell and operably linked to a polynucleotide selected from: (a) DNA encoding a cleavage blocker to prevent or decrease small RNA-mediated cleavage of the transcript of the miRNA target; (b) DNA encoding a 5'-modified cleavage blocker to prevent or decrease small RNA-mediated cleavage of the transcript of the miRNA target; (c) DNA encoding a translational inhibitor to prevent or decrease small RNA-mediated cleavage of the transcript of the miRNA target; (d) DNA encoding a decoy to prevent or decrease small RNA-mediated cleavage of the transcript of the miRNA target; (e) DNA encoding a miRNA-unresponsive transgene having a nucleotide sequence derived from the native nucleotide sequence of the miRNA target, wherein a miRNA recognition site in the native nucleotide sequence is deleted or otherwise modified to prevent miRNA-mediated cleavage; (f) DNA encoding a miRNA precursor which is processed into a miRNA for suppressing expression of the miRNA target; (g) DNA encoding double-stranded RNA which is processed into siRNAs for suppressing expression the miRNA target; and (h) DNA encoding a ta-siRNA which is processed into siRNAs for suppressing expression of the miRNA target—wherein separate constructs are made for each of the miRNA targets enumerated in Table 5.

The above process is repeated to produce multiple events of transgenic maize plant cells that are transformed with each of the following recombinant DNA constructs of this invention, i.e., a construct transcribable in a maize plant cell, including a promoter that is functional in the maize plant cell and operably linked to each polynucleotide provided in Table 6, wherein separate constructs are made for each polynucleotide.

The above process is repeated to produce multiple events of transgenic maize plant cells that are transformed with each of the following recombinant DNA constructs of this invention, erated transgenic maize plants, are screened for an enhanced trait (e.g., increased yield), as compared to a control plant or seed (a plant or seed lacking expression of the recombinant DNA construct). From each group of multiple events of transgenic maize plants with a specific recombinant construct of this invention, the event that produces the greatest enhanced trait (e.g., greatest enhancement in yield) is identified and progeny maize seed is selected for commercial development.

TABLE 4

| Function | Name | Annotation | Coordinates of SEQ ID NO: 2065 |
|---|---|---|---|
| Agrobacterium T-DNA transfer | B-AGRtu.right border | Agro right border sequence, essential for transfer of T-DNA. | 11364-11720 |
| Gene of interest expression cassette | E-Os.Act1 | Upstream promoter region of the rice actin 1 gene | 19-775 |
| | E-CaMV.35S.2xA1-B3 | Duplicated35S A1-B3 domain without TATA box | 788-1120 |
| | P-Os.Act1 | Promoter region of the rice actin 1 gene | 1125-1204 |
| | L-Ta.Lhcb1 | 5' untranslated leader of wheat major chlorophyll a/b binding protein | 1210-1270 |
| | I-Os.Act1 | First intron and flanking UTR exon sequences from the rice actin 1 gene | 1287-1766 |
| | T-St.Pis4 | 3' non-translated region of the potato proteinase inhibitor II gene which functions to direct polyadenylation of the mRNA | 1838-2780 |
| Plant selectable marker expression cassette | P-Os.Act1 | Promoter from the rice actin 1 gene | 2830-3670 |
| | L-Os.Act1 | First exon of the rice actin 1 gene | 3671-3750 |
| | I-Os.Act1 | First intron and flanking UTR exon sequences from the rice actin 1 gene | 3751-4228 |
| | TS-At.ShkG-CTP2 | Transit peptide region of *Arabidopsis* EPSPS | 4238-4465 |
| | CR-AGRtu.aroA-CP4.nat | Coding region for bacterial strain CP4 native aroA gene. | 4466-5833 |
| | T-AGRtu.nos | A 3' non-translated region of the nopaline synthase gene of *Agrobacterium tumefaciens* Ti plasmid which functions to direct polyadenylation of the mRNA. | 5849-6101 |
| Agrobacterium T-DNA transfer | B-AGRtu.left border | Agro left border sequence, essential for transfer of T-DNA. | 6168-6609 |
| Maintenance in *E. coli* | OR-Ec.oriV-RK2 | The vegetative origin of replication from plasmid RK2. | 6696-7092 |
| | CR-Ec.rop | Coding region for repressor of primer from the ColE1 plasmid. Expression of this gene product interferes with primer binding at the origin of replication, keeping plasmid copy number low. | 8601-8792 |
| | OR-Ec.ori-ColE1 | The minimal origin of replication from the *E. coli* plasmid ColE1. | 9220-9808 |
| | P-Ec.aadA-SPC/STR | Promoter for Tn7 adenylyltransferase (AAD(3")) | 10339-10380 |
| | CR-Ec.aadA-SPC/STR | Coding region for Tn7 adenylyltransferase (AAD(3")) conferring spectinomycin and streptomycin resistance. | 10381-11169 |
| | T-Ec.aadA-SPC/STR | 3' UTR from the Tn7 adenylyltransferase (AAD(3")) gene of *E. coli*. | 11170-11227 | i.e., a construct transcribable in a maize plant cell, including a promoter that is functional in the plant cell and operably linked to a polynucleotide selected from DNA encoding each miRNA target identified in Tables 2 and 3.

The above process is repeated to produce multiple events of transgenic maize plant cells that are transformed with each of the following recombinant DNA constructs of this invention, i.e., a construct transcribable in a maize plant cell, including a promoter that is functional in the plant cell and operably linked to each polynucleotide of SEQ ID NOS: 15-2064.

The regenerated transgenic maize plants, or progeny transgenic maize plants or maize seeds, produced from the regen-

TABLE 5 miRNA Targets a miR156 target, a miR160 target, a miR164 target, a miR166 target, a miR167 target, a miR169 target, a miR171 target, a miR172 target, a miR319 target, miR395 target, a miR396 target, a a miR398 target, a miR399 target, a miR408 target, a miR444 target, a miR528 target, a miR167g target, a miR169g target, COP1 (constitutive photomorphogenesis1), GA2ox (gibberellic acid 2 oxidase), GA20ox (gibberellic acid 20 oxidase), HB2 (homeobox 2), HB2-4 (homeobox 2 and homeobox 4), HB4 (homeobox 4), LG1 (liguleless1), SPX (SYG1, PHO81 and XPR1 domain; PFAM entry PF03105 at www.sanger.ac.uk), VIM1a (variant in methlylation 1a), DHS1 (deoxyhypusine synthase), DHS2 (deoxyhypusine synthase), DHS3 (deoxyhypusine synthase),

TABLE 5-continued miRNA Targets

DHS4 (deoxyhypusine synthase), DHS5 (deoxyhypusine synthase), DHS6 (deoxyhypusine synthase), DHS7 (deoxyhypusine synthase), DHS8 (deoxyhypusine synthase), CRF (corn RING finger; RNF169), G1543a (maize orthologue of *Arabidopsis thaliana* homeobox 17), G1543b (maize orthologue of *Arabidopsis thaliana* homeobox 17), GS3 (grain size 3), and GW2 (grain weight 2)

TABLE 6

Polynucleotides Expressed by Constructs of This Invention

SEQ ID NOs: 1120, 1121, 1122, 1248, 1257, 1313, 1314, 1364, 1387, 1478, 1489, 1490, 1491, 1492, 1493, 1585, 1597, 1598, 1599, 1713, 1752, 1753, 1801, 1802, 1820, 1927, 1929, 1931, 1971, 2006, 2007, 2008, 2010, 2012, 2014, 2016, 2018, 2022, 2023, 2025, 2027, 2029, 2031, 2033, 2035, 2037, 2039, 2041, 2043, 2045, 2047, 2049, 2051, 2053, 2055, 2056, 2057, 2059, 2060, 2061, and 2063

Transformation of Soybean

Figure 3:
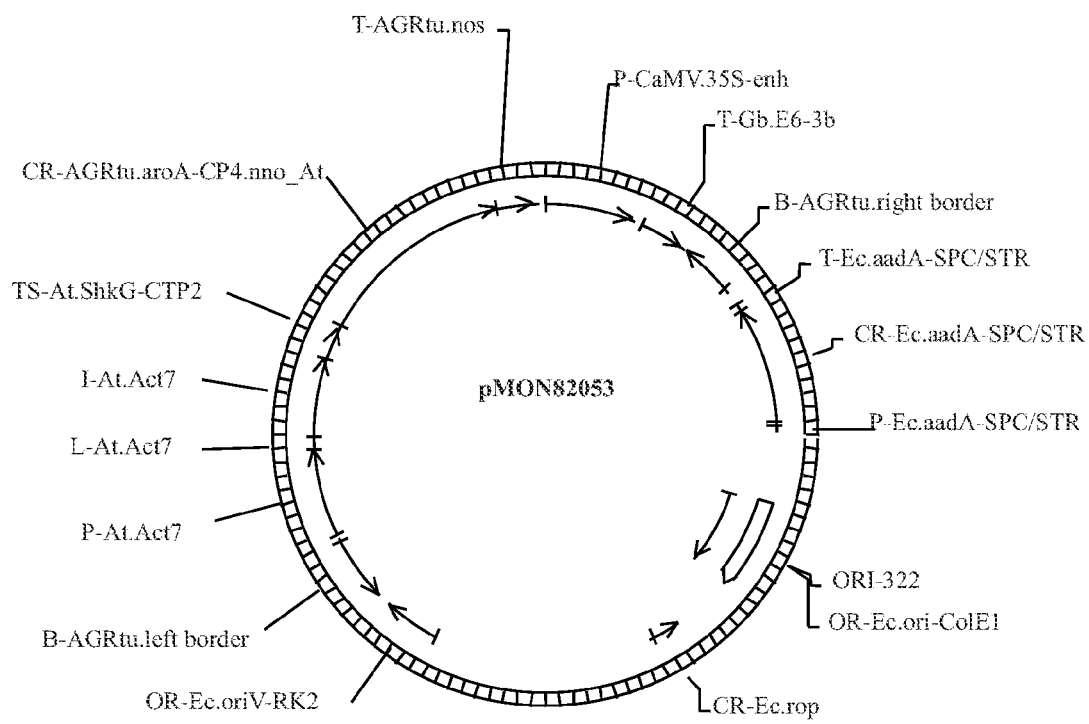
FIG. 3 depicts a soybean or cotton transformation base vector (pMON82053, SEQ ID NO: 2066), as described in Example 5.

A base transformation vector pMON82053 (SEQ ID NO: 2066), illustrated in Table 7 and FIG. 3, is used in preparing recombinant DNA constructs of this invention for *Agrobacterium*-mediated transformation into soybean cells or tissue. To construct a transformation vector for expressing any of the recombinant DNA constructs of this invention, nucleotides encoding the at least one polynucleotide are inserted into the base vector pMON82053 (SEQ ID NO: 2066) in the gene of interest expression cassette at an insertion site, i.e., between the promoter element (coordinates 1-613) and the polyadenylation element (coordinates 688-1002). For example, a transformation vector for expression of a miR399 cleavage blocker is prepared by inserting the DNA of SEQ ID NO: 1802 (see Table 3) into the gene of interest expression cassette at an insertion site between the promoter element (coordinates 1-613) and the polyadenylation element (coordinates 688-1002) of pMON82053 (SEQ ID NO: 2066).

For *Agrobacterium*-mediated transformation, soybean seeds are imbided overnight and the meristem explants excised and placed in a wounding vessel. Cultures of induced *Agrobacterium* cells each containing a transformation vector for expressing each of the recombinant DNA constructs of this invention are mixed with prepared explants. Inoculated explants are wounded using sonication, placed in co-culture for 2-5 days, and transferred to selection media for 6-8 weeks to allow selection and growth of transgenic shoots. Resistant shoots are harvested at approximately 6-8 weeks and placed into selective rooting media for 2-3 weeks. Shoots producing roots are transferred to the greenhouse and potted in soil.

The above process is repeated to produce multiple events of transgenic soybean plant cells that are transformed with separate recombinant DNA constructs of this invention, i.e., a construct transcribable in a soybean plant cell, including a promoter that is functional in the soybean plant cell and operably linked to each polynucleotide selected from: (a) DNA encoding a cleavage blocker to prevent or decrease small RNA-mediated cleavage of the transcript of each miRNA target identified in Tables 2 and 3; (b) DNA encoding a 5'-modified cleavage blocker to prevent or decrease small RNA-mediated cleavage of the transcript of each miRNA target identified in Tables 2 and 3; (c) DNA encoding a translational inhibitor to prevent or decrease small RNA-mediated cleavage of the transcript of each miRNA target identified in Tables 2 and 3; (d) DNA encoding a decoy to prevent or decrease small RNA-mediated cleavage of the transcript of each miRNA target identified in Tables 2 and 3; (e) DNA encoding a miRNA-unresponsive transgene having a nucleotide sequence derived from the native nucleotide sequence of each miRNA target identified in Tables 2 and 3, wherein a miRNA recognition site in the native nucleotide sequence is deleted or otherwise modified to prevent miRNA-mediated cleavage; (f) DNA encoding a miRNA precursor which is processed into a miRNA for suppressing expression of each miRNA target identified in Tables 2 and 3; (g) DNA encoding double-stranded RNA which is processed into siRNAs for suppressing expression of each miRNA target identified in Tables 2 and 3; and (h) DNA encoding a ta-siRNA which is processed into siRNAs for suppressing expression of each miRNA target identified in Tables 2 and 3.

The above process is repeated to produce multiple events of transgenic soybean plant cells that are transformed with each of the following recombinant DNA constructs of this invention, i.e., a construct transcribable in a soybean plant cell, including a promoter that is functional in the soybean plant cell and operably linked to a polynucleotide selected from: (a) DNA encoding a cleavage blocker to prevent or decrease small RNA-mediated cleavage of the transcript of the miRNA target; (b) DNA encoding a 5'-modified cleavage blocker to prevent or decrease small RNA-mediated cleavage of the transcript of the miRNA target; (c) DNA encoding a translational inhibitor to prevent or decrease small RNA-mediated cleavage of the transcript of the miRNA target; (d) DNA encoding a decoy to prevent or decrease small RNA-mediated cleavage of the transcript of the miRNA target; (e) DNA encoding a miRNA-unresponsive transgene having a nucleotide sequence derived from the native nucleotide sequence of the miRNA target, wherein a miRNA recognition site in the native nucleotide sequence is deleted or otherwise modified to prevent miRNA-mediated cleavage; (f) DNA encoding a miRNA precursor which is processed into a miRNA for suppressing expression of the miRNA target; (g) DNA encoding double-stranded RNA which is processed into siRNAs for suppressing expression the miRNA target; and (h) DNA encoding a ta-siRNA which is processed into siRNAs for suppressing expression of the miRNA target—wherein separate constructs are made for each of the miRNA targets enumerated in Table 5.

The above process is repeated to produce multiple events of transgenic soybean plant cells that are transformed with each of the following recombinant DNA constructs of this invention, i.e., a construct transcribable in a soybean plant cell, including a promoter that is functional in the soybean plant cell and operably linked to each polynucleotide provided in Table 6, wherein separate constructs are made for each polynucleotide.

The above process is repeated to produce multiple events of transgenic soybean plant cells that are transformed with each of the following recombinant DNA constructs of this invention, i.e., a construct transcribable in a soybean plant cell, including a promoter that is functional in the plant cell and operably linked to a polynucleotide selected from DNA encoding each miRNA target identified in Tables 2 and 3.

The above process is repeated to produce multiple events of transgenic soybean plant cells that are transformed with each of the following recombinant DNA constructs of this invention, i.e., a construct transcribable in a soybean plant cell, including a promoter that is functional in the plant cell and operably linked to each polynucleotide of SEQ ID NOS: 15-2064.

The regenerated transgenic soybean plants, or progeny transgenic soybean plants or soybean seeds, produced from the regenerated transgenic soybean plants, are screened for an enhanced trait (e.g., increased yield), as compared to a control plant or seed (a plant or seed lacking expression of the recombinant DNA construct). From each group of multiple events of transgenic soybean plants with a specific recombinant construct of this invention, the event that produces the greatest enhanced trait (e.g., greatest enhancement in yield) is identified and progeny soybean seed is selected for commercial development.

Transformation of Canola

A base transformation vector pMON82053 (SEQ ID NO: 2066), illustrated in Table 7 and FIG. 3, is used in preparing recombinant DNA constructs of this invention for *Agrobacterium*-mediated transformation into canola cells or tissue. To construct a transformation vector for expressing any of the recombinant DNA constructs of this invention, nucleotides encoding the at least one polynucleotide are inserted into the base vector pMON82053 (SEQ ID NO: 2066) in the gene of interest expression cassette at an insertion site, i.e., between the promoter element (coordinates 1-613) and the polyadenylation element (coordinates 688-1002). For example, a transformation vector for expression of a miR399 cleavage blocker is prepared by inserting the DNA of SEQ ID NO: 1802 (see Table 3) into the gene of interest expression cassette at an insertion site between the promoter element (coordinates 1-613) and the polyadenylation element (coordinates 688-1002) of pMON82053 (SEQ ID NO: 2066).

Overnight-grown cultures of *Agrobacterium* cells each containing a transformation vector for expressing each of the recombinant DNA constructs of this invention are used to inoculate tissues from in vitro-grown canola seedlings. Following co-cultivation with *Agrobacterium*, the infected tissues are grown on selection to promote growth of transgenic shoots, followed by growth of roots from the transgenic shoots, potting of the selected plantlets in soil, and transfer of the potted plants to the greenhouse. Molecular characterization is performed to confirm the presence of a recombinant DNA construct of this invention and its expression in transgenic plants.

The above process is repeated to produce multiple events of transgenic canola plant cells that are transformed with separate recombinant DNA constructs of this invention, i.e., a construct transcribable in a canola plant cell, including a promoter that is functional in the canola plant cell and operably linked to each polynucleotide selected from: (a) DNA encoding a cleavage blocker to prevent or decrease small RNA-mediated cleavage of the transcript of each miRNA target identified in Tables 2 and 3; (b) DNA encoding a 5'-modified cleavage blocker to prevent or decrease small RNA-mediated cleavage of the transcript of each miRNA target identified in Tables 2 and 3; (c) DNA encoding a translational inhibitor to prevent or decrease small RNA-mediated cleavage of the transcript of each miRNA target identified in Tables 2 and 3; (d) DNA encoding a decoy to prevent or decrease small RNA-mediated cleavage of the transcript of each miRNA target identified in Tables 2 and 3; (e) DNA encoding a miRNA-unresponsive transgene having a nucleotide sequence derived from the native nucleotide sequence of each miRNA target identified in Tables 2 and 3, wherein a miRNA recognition site in the native nucleotide sequence is deleted or otherwise modified to prevent miRNA-mediated cleavage; (f) DNA encoding a miRNA precursor which is processed into a miRNA for suppressing expression of each miRNA target identified in Tables 2 and 3; (g) DNA encoding double-stranded RNA which is processed into siRNAs for suppressing expression of each miRNA target identified in Tables 2 and 3; and (h) DNA encoding a ta-siRNA which is processed into siRNAs for suppressing expression of each miRNA target identified in Tables 2 and 3.

The above process is repeated to produce multiple events of transgenic canola plant cells that are transformed with each of the following recombinant DNA constructs of this invention, i.e., a construct transcribable in a canola plant cell, including a promoter that is functional in the canola plant cell and operably linked to a polynucleotide selected from: (a) DNA encoding a cleavage blocker to prevent or decrease small RNA-mediated cleavage of the transcript of the miRNA target; (b) DNA encoding a 5'-modified cleavage blocker to prevent or decrease small RNA-mediated cleavage of the transcript of the miRNA target; (c) DNA encoding a translational inhibitor to prevent or decrease small RNA-mediated cleavage of the transcript of the miRNA target; (d) DNA encoding a decoy to prevent or decrease small RNA-mediated cleavage of the transcript of the miRNA target; (e) DNA encoding a miRNA-unresponsive transgene having a nucleotide sequence derived from the native nucleotide sequence of the miRNA target, wherein a miRNA recognition site in the native nucleotide sequence is deleted or otherwise modified to prevent miRNA-mediated cleavage; (f) DNA encoding a miRNA precursor which is processed into a miRNA for suppressing expression of the miRNA target; (g) DNA encoding double-stranded RNA which is processed into siRNAs for suppressing expression the miRNA target; and (h) DNA encoding a ta-siRNA which is processed into siRNAs for suppressing expression of the miRNA target—wherein separate constructs are made for each of the miRNA targets enumerated in Table 5.

The above process is repeated to produce multiple events of transgenic canola plant cells that are transformed with each of the following recombinant DNA constructs of this invention, i.e., a construct transcribable in a canola plant cell, including a promoter that is functional in the canola plant cell and operably linked to each polynucleotide provided in Table 6, wherein separate constructs are made for each polynucleotide.

The above process is repeated to produce multiple events of transgenic canola plant cells that are transformed with each of the following recombinant DNA constructs of this invention, i.e., a construct transcribable in a canola plant cell, including a promoter that is functional in the plant cell and operably linked to a polynucleotide selected from DNA encoding each miRNA target identified in Tables 2 and 3.

The above process is repeated to produce multiple events of transgenic canola plant cells that are transformed with each of the following recombinant DNA constructs of this invention, i.e., a construct transcribable in a canola plant cell, including a promoter that is functional in the plant cell and operably linked to each polynucleotide of SEQ ID NOS: 15-2064.

The regenerated transgenic canola plants, or progeny transgenic canola plants or canola seeds, produced from the regenerated transgenic canola plants, are screened for an enhanced trait (e.g., increased yield), as compared to a control plant or seed (a plant or seed lacking expression of the recombinant DNA construct). From each group of multiple events of transgenic canola plants with a specific recombinant construct of this invention, the event that produces the greatest enhanced trait (e.g., greatest enhancement in yield) is identified and progeny canola seed is selected for commercial development.

Transformation of Cotton

Figure 4:
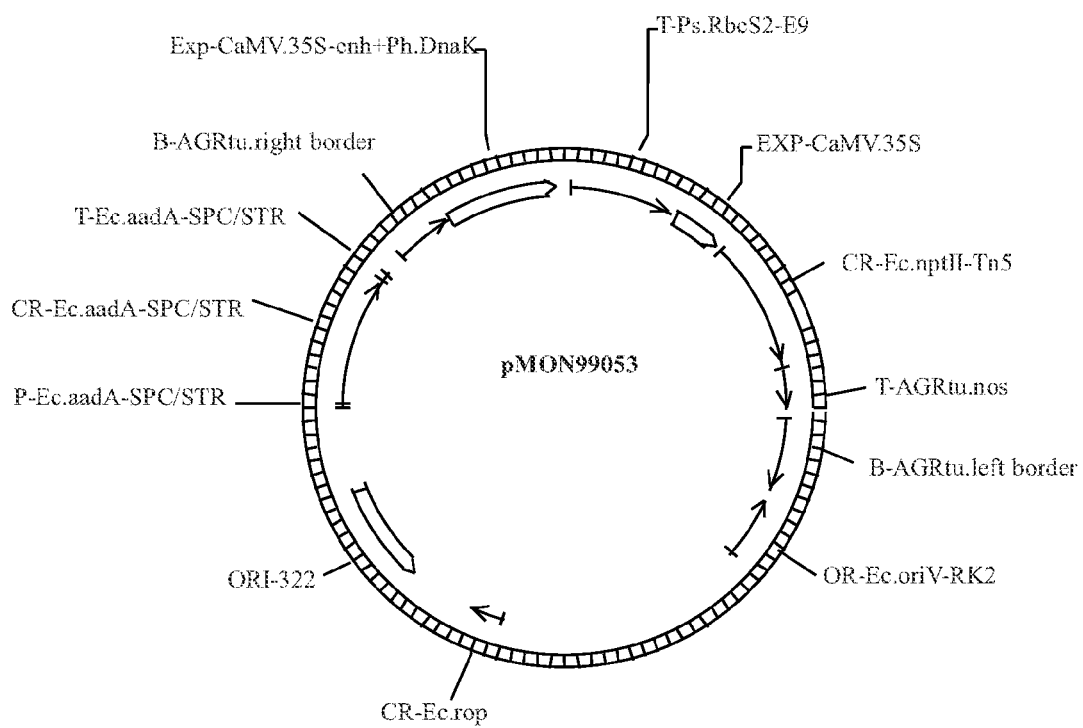
FIG. 4 depicts a cotton transformation base vector (pMON99053, SEQ ID NO: 2067), as described in Example 5.

A base transformation vector pMON99053 (SEQ ID NO: 2067), illustrated in Table 8 and FIG. 4, is used in preparing recombinant DNA constructs of this invention for *Agrobacterium*-mediated transformation into maize cells or tissue. To construct a transformation vector for expressing any of the recombinant DNA constructs of this invention, nucleotides encoding the at least one polynucleotide are inserted into the base vector pMON99053 (SEQ ID NO: 2067) in the gene of interest expression cassette at an insertion site, i.e., between the promoter element (coordinates 388-1091) and the polyadenylation element (coordinates 1165-1791).

Methods for transformation of cotton are known in the art, see, for example, the techniques described in U.S. Patent Application Publications 2004/0087030A1 2008/0256667A1, 2008/0280361A1, and 2009/0138985A1, which are incorporated by reference. In an example of a cotton transformation protocol, seeds of transformable cotton genotypes (e.g., nectarless, DP393, OOSO4, 07W610F, STN474, Delta Pearl, DP5415, SureGrow501, or SureGrow747) are surface sterilized, rinsed, and hydrated in CSM medium (containing carbenicillin, cefotaxime, BRAVO, and Captan 50) for 14 to 42 hours in the dark. Meristematic explants are processed from seeds as described in U.S. Patent Application Publications 2008/0256667A1. Cultures of *Agrobacterium* cells each containing a transformation vector for expressing each of the recombinant DNA constructs of this invention are used to inoculate the explants using sonication. The inoculum is removed and the inoculated explants transferred to INO medium and incubated for 2 to 5 days using a 16-hour light photoperiod. Following co-cultivation, explants are transferred onto semi-solid selection medium (modified Lloyd & McCown Woody Plant Medium supplemented with 200 mg/L cefotaxime, 200 mg/L carbenicillin and 100-200 mg/L spectinomycin) with or without plant growth regulators or other additives to promote multiple shoot formation and growth. The explants are cultured in a 16-hour light photoperiod. After 4 to 6 weeks on the selection medium those explants that have developed green shoots are transferred to plugs and placed in liquid medium containing 0.25 mg/L IBA for shoot growth and rooting under plastic domes for 3 to 4 weeks. Tissues are assayed for molecular characterization by one or more molecular assay methods (e.g., PCR, or Southern blots).

The above process is repeated to produce multiple events of transgenic cotton plant cells that are transformed with separate recombinant DNA constructs of this invention, i.e., a construct transcribable in a cotton plant cell, including a promoter that is functional in the cotton plant cell and operably linked to each polynucleotide selected from: (a) DNA encoding a cleavage blocker to prevent or decrease small RNA-mediated cleavage of the transcript of each miRNA target identified in Tables 2 and 3; (b) DNA encoding a 5'-modified cleavage blocker to prevent or decrease small RNA-mediated cleavage of the transcript of each miRNA target identified in Tables 2 and 3; (c) DNA encoding a translational inhibitor to prevent or decrease small RNA-mediated cleavage of the transcript of each miRNA target identified in Tables 2 and 3; (d) DNA encoding a decoy to prevent or decrease small RNA-mediated cleavage of the transcript of each miRNA target identified in Tables 2 and 3; (e) DNA encoding a miRNA-unresponsive transgene having a nucleotide sequence derived from the native nucleotide sequence of each miRNA target identified in Tables 2 and 3, wherein a miRNA recognition site in the native nucleotide sequence is deleted or otherwise modified to prevent miRNA-mediated cleavage; (f) DNA encoding a miRNA precursor which is processed into a miRNA for suppressing expression of each miRNA target identified in Tables 2 and 3; (g) DNA encoding double-stranded RNA which is processed into siRNAs for suppressing expression of each miRNA target identified in Tables 2 and 3; and (h) DNA encoding a ta-siRNA which is processed into siRNAs for suppressing expression of each miRNA target identified in Tables 2 and 3.

The above process is repeated to produce multiple events of transgenic cotton plant cells that are transformed with each of the following recombinant DNA constructs of this invention, i.e., a construct transcribable in a cotton plant cell, including a promoter that is functional in the cotton plant cell and operably linked to a polynucleotide selected from: (a) DNA encoding a cleavage blocker to prevent or decrease small RNA-mediated cleavage of the transcript of the miRNA target; (b) DNA encoding a 5'-modified cleavage blocker to prevent or decrease small RNA-mediated cleavage of the transcript of the miRNA target; (c) DNA encoding a translational inhibitor to prevent or decrease small RNA-mediated cleavage of the transcript of the miRNA target; (d) DNA encoding a decoy to prevent or decrease small RNA-mediated cleavage of the transcript of the miRNA target; (e) DNA encoding a miRNA-unresponsive transgene having a nucleotide sequence derived from the native nucleotide sequence of the miRNA target, wherein a miRNA recognition site in the native nucleotide sequence is deleted or otherwise modified to prevent miRNA-mediated cleavage; (f) DNA encoding a miRNA precursor which is processed into a miRNA for suppressing expression of the miRNA target; (g) DNA encoding double-stranded RNA which is processed into siRNAs for suppressing expression the miRNA target; and (h) DNA encoding a ta-siRNA which is processed into siRNAs for suppressing expression of the miRNA target—wherein separate constructs are made for each of the miRNA targets enumerated in Table 5.

The above process is repeated to produce multiple events of transgenic cotton plant cells that are transformed with each of the following recombinant DNA constructs of this invention, i.e., a construct transcribable in a cotton plant cell, including a promoter that is functional in the cotton plant cell and operably linked to each polynucleotide provided in Table 6, wherein separate constructs are made for each polynucleotide.

The above process is repeated to produce multiple events of transgenic cotton plant cells that are transformed with each of the following recombinant DNA constructs of this invention, i.e., a construct transcribable in a cotton plant cell, including a promoter that is functional in the plant cell and operably linked to a polynucleotide selected from DNA encoding each miRNA target identified in Tables 2 and 3.

The above process is repeated to produce multiple events of transgenic cotton plant cells that are transformed with each of the following recombinant DNA constructs of this invention, i.e., a construct transcribable in a cotton plant cell, including a promoter that is functional in the plant cell and operably linked to each polynucleotide of SEQ ID NOS: 15-2064.

The regenerated transgenic cotton plants, or progeny transgenic cotton plants or cotton seeds, produced from the regenerated transgenic cotton plants, are screened for an enhanced trait (e.g., increased yield), as compared to a control plant or seed (a plant or seed lacking expression of the recombinant DNA construct). From each group of multiple events of transgenic cotton plants with a specific recombinant construct of this invention, the event that produces the greatest enhanced trait (e.g., greatest enhancement in yield) is identified and progeny cotton seed is selected for commercial development.

TABLE 7

| Function | Name | Annotation | Coordinates of SEQ ID NO: 2066 |
|---|---|---|---|
| *Agrobacterium* T-DNA transfer | B-AGRtu.left border | Agro left border sequence, essential for transfer of T-DNA. | 6144-6585 |
| Plant selectable marker expression cassette | P-At.Act7 | Promoter from the *Arabidopsis* actin 7 gene | 6624-7861 |
| | L-At.Act7 | 5'UTR of *Arabidopsis* Act7 gene | |
| | I-At.Act7 | Intron from the *Arabidopsis* actin7 gene | |
| | TS-At.ShkG-CTP2 | Transit peptide region of *Arabidopsis* EPSPS | 7864-8091 |
| | CR-AGRtu.aroA-CP4.nno__At | Synthetic CP4 coding region with dicot preferred codon usage. | 8092-9459 |
| | T-AGRtu.nos | A 3' non-translated region of the nopaline synthase gene of *Agrobacterium tumefaciens* Ti plasmid which functions to direct polyadenylation of the mRNA. | 9466-9718 |
| Gene of interest expression cassette | P-CaMV.35S-enh | Promoter for 35S RNA from CaMV containing a duplication of the −90 to −350 region. | 1-613 |
| | T-Gb.E6-3b | 3' untranslated region from the fiber protein E6 gene of sea-island cotton. | 688-1002 |
| *Agrobacterium* T-DNA transfer | B-AGRtu.right border | Agro right border sequence, essential for transfer of T-DNA. | 1033-1389 |
| Maintenance in *E. coli* | OR-Ec.oriV-RK2 | The vegetative origin of replication from plasmid RK2. | 5661-6057 |
| | CR-Ec.rop | Coding region for repressor of primer from the ColE1 plasmid. Expression of this gene product interferes with primer binding at the origin of replication, keeping plasmid copy number low. | 3961-4152 |
| | OR-Ec.ori-ColE1 | The minimal origin of replication from the *E. coli* plasmid ColE1. | 2945-3533 |
| | P-Ec.aadA-SPC/STR | Promoter for Tn7 adenylyltransferase (AAD(3″)) | 2373-2414 |
| | CR-Ec.aadA-SPC/STR | Coding region for Tn7 adenylyltransferase (AAD(3″)) conferring spectinomycin and streptomycin resistance. | 1584-2372 |
| | T-Ec.aadA-SPC/STR | 3' UTR from the Tn7 adenylyltransferase (AAD(3″)) gene of *E. coli*. | 1526-1583 |

TABLE 8

| Function | Name | Annotation | Coordinates of SEQ ID NO: 2067 |
|---|---|---|---|
| *Agrobacterium* T-DNA transfer | B-AGRtu.right border | Agro right border sequence, essential for transfer of T-DNA. | 1-357 |
| Gene of interest expression cassette | Exp-CaMV.35S-enh + Ph.DnaK | Enhanced version of the 35S RNA promoter from CaMV plus the *petunia* hsp70 5' untranslated region | 388-1091 |
| | T-Ps.RbcS2-E9 | The 3' non-translated region of the pea RbcS2 gene which functions to direct polyadenylation of the mRNA. | 1165-1797 |
| Plant selectable marker expression cassette | Exp-CaMV.35S | Promoter and 5' untranslated region from the 35S RNA of CaMV | 1828-2151 |
| | CR-Ec.nptII-Tn5 | Coding region for neomycin phosphotransferase gene from transposon Tn5 which confers resistance to neomycin and kanamycin. | 2185-2979 |
| | T-AGRtu.nos | A 3' non-translated region of the nopaline synthase gene of *Agrobacterium tumefaciens* Ti plasmid which functions to direct polyadenylation of the mRNA. | 3011-3263 |
| *Agrobacterium* T-DNA transfer | B-AGRtu.left border | Agro left border sequence, essential for transfer of T-DNA. | 3309-3750 |
| Maintenance in *E. coli* | OR-Ec.oriV-RK2 | The vegetative origin of replication from plasmid RK2. | 3837-4233 |
| | CR-Ec.rop | Coding region for repressor of primer from the ColE1 plasmid. Expression of this gene product interferes with primer binding at | 5742-5933 |

TABLE 8-continued

| Function | Name | Annotation | Coordinates of SEQ ID NO: 2067 |
|---|---|---|---|
| | OR-Ec.ori-ColE1 | the origin of replication, keeping plasmid copy number low. The minimal origin of replication from the *E. coli* plasmid ColE1. | 6361-6949 |
| | P-Ec.aadA-SPC/STR | Promoter for Tn7 adenylyltransferase (AAD(3")) | 7480-7521 |
| | CR-Ec.aadA-SPC/STR | Coding region for Tn7 adenylyltransferase (AAD(3")) conferring spectinomycin and streptomycin resistance. | 7522-8310 |
| | T-Ec.aadA-SPC/STR | 3' UTR from the Tn7 adenylyltransferase (AAD(3")) gene of *E. coli*. | 8311-8368 |

Transformation of Sugarcane

Sugarcane transformation techniques are known in the art; see, for example, the procedures described for sugarcane by Brumbley et al. in "Sugarcane" (available electronically at mrw.interscience.wiley.com/emrw/9781405181099/hpt/article/k0701/current/pdf), published in: "Compendium of Transgenic Crop Plants", edited by Chittaranjan Kole and Timothy C. Hall, Blackwell Publishing Ltd., 2008; *ISBN* 978-1-405-16924-0 (available electronically at mrw.interscience.wiley.com/emrw/9781405181099/hpt/toc), and in PCT International Patent Application Publications WO2007/003023 (sugarcane) and WO2008/049183 (sugarcane). In one example of sugarcane transformation (see Example 3 of PCT International Patent Application Publication WO2007003023A2), embryonic sugarcane callus cultures are established from apical meristem and primordial leafs of sugarcane (*Saccharum* spp. hybrid). Eight-week old calli are co-bombarded with an equimolar mixture of either UBI-1:: Bar::NOSpolyA and UBI-1::Oas::NOSpolyA or UBI-1:: Bar::NOSpolyA and UBI-1::CPs::NOSpolyA expression cassettes (10 pg DNAI3/mg particle) by particle bombardment as described previously (Sanford (1990) *Plant Physiol.*, 79:206-209). After bombardment, calli are transferred to MS medium containing 1 mg/L PPT and 1 mg/L BAP to promote shoot regeneration and inhibit development of non transgenic tissue. Two weeks later, calli are transferred to MS medium containing 1 mg/L PPT and 1 mg/L Affi for shoot elongation and to induce root formation. After two weeks, plantlets are placed into magenta boxes for acclimatization and 2 weeks later, shoots (10-15 cm) with well developed roots are transferred to potting soil and placed in the greenhouse.

The above process is repeated to produce multiple events of transgenic sugarcane plant cells that are transformed with separate recombinant DNA constructs of this invention, i.e., a construct transcribable in a sugarcane plant cell, including a promoter that is functional in the sugarcane plant cell and operably linked to each polynucleotide selected from: (a) DNA encoding a cleavage blocker to prevent or decrease small RNA-mediated cleavage of the transcript of each miRNA target identified in Tables 2 and 3; (b) DNA encoding a 5'-modified cleavage blocker to prevent or decrease small RNA-mediated cleavage of the transcript of each miRNA target identified in Tables 2 and 3; (c) DNA encoding a translational inhibitor to prevent or decrease small RNA-mediated cleavage of the transcript of each miRNA target identified in Tables 2 and 3; (d) DNA encoding a decoy to prevent or decrease small RNA-mediated cleavage of the transcript of each miRNA target identified in Tables 2 and 3; (e) DNA encoding a miRNA-unresponsive transgene having a nucleotide sequence derived from the native nucleotide sequence of each miRNA target identified in Tables 2 and 3, wherein a miRNA recognition site in the native nucleotide sequence is deleted or otherwise modified to prevent miRNA-mediated cleavage; (f) DNA encoding a miRNA precursor which is processed into a miRNA for suppressing expression of each miRNA target identified in Tables 2 and 3; (g) DNA encoding double-stranded RNA which is processed into siRNAs for suppressing expression of each miRNA target identified in Tables 2 and 3; and (h) DNA encoding a ta-siRNA which is processed into siRNAs for suppressing expression of each miRNA target identified in Tables 2 and 3.

The above process is repeated to produce multiple events of transgenic sugarcane plant cells that are transformed with each of the following recombinant DNA constructs of this invention, i.e., a construct transcribable in a sugarcane plant cell, including a promoter that is functional in the sugarcane plant cell and operably linked to a polynucleotide selected from: (a) DNA encoding a cleavage blocker to prevent or decrease small RNA-mediated cleavage of the transcript of the miRNA target; (b) DNA encoding a 5'-modified cleavage blocker to prevent or decrease small RNA-mediated cleavage of the transcript of the miRNA target; (c) DNA encoding a translational inhibitor to prevent or decrease small RNA-mediated cleavage of the transcript of the miRNA target; (d) DNA encoding a decoy to prevent or decrease small RNA-mediated cleavage of the transcript of the miRNA target; (e) DNA encoding a miRNA-unresponsive transgene having a nucleotide sequence derived from the native nucleotide sequence of the miRNA target, wherein a miRNA recognition site in the native nucleotide sequence is deleted or otherwise modified to prevent miRNA-mediated cleavage; (f) DNA encoding a miRNA precursor which is processed into a miRNA for suppressing expression of the miRNA target; (g) DNA encoding double-stranded RNA which is processed into siRNAs for suppressing expression the miRNA target; and (h) DNA encoding a ta-siRNA which is processed into siRNAs for suppressing expression of the miRNA target—wherein separate constructs are made for each of the miRNA targets enumerated in Table 5.

The above process is repeated to produce multiple events of transgenic sugarcane plant cells that are transformed with each of the following recombinant DNA constructs of this invention, i.e., a construct transcribable in a sugarcane plant cell, including a promoter that is functional in the sugarcane plant cell and operably linked to each polynucleotide provided in Table 6, wherein separate constructs are made for each polynucleotide.

The above process is repeated to produce multiple events of transgenic sugarcane plant cells that are transformed with each of the following recombinant DNA constructs of this invention, i.e., a construct transcribable in a sugarcane plant cell, including a promoter that is functional in the plant cell and operably linked to a polynucleotide selected from DNA encoding each miRNA target identified in Tables 2 and 3.

The above process is repeated to produce multiple events of transgenic sugarcane plant cells that are transformed with each of the following recombinant DNA constructs of this invention, i.e., a construct transcribable in a sugarcane plant cell, including a promoter that is functional in the plant cell and operably linked to each polynucleotide of SEQ ID NOS: 15-2064.

The regenerated transgenic sugarcane plants, or progeny transgenic sugarcane plants or sugarcane seeds, produced from the regenerated transgenic sugarcane plants, are screened for an enhanced trait (e.g., increased yield), as compared to a control plant or seed (a plant or seed lacking expression of the recombinant DNA construct). From each group of multiple events of transgenic sugarcane plants with a specific recombinant construct of this invention, the event that produces the greatest enhanced trait (e.g., greatest enhancement in yield) is identified and progeny sugarcane seed is selected for commercial development.

Further Embodiments

A miRNA decoy competes with the endogenous target gene to bind to that particular miRNA and thus reduces the effect of the miRNA in the biochemical network or networks involving the miRNA. Decoys include endogenous (native) miRNA decoy sequences, decoys created by manipulating an endogenous sequence (e.g., by chemical or other mutagenesis or site-directed recombination), and synthetic miRNA decoy sequences. A recombinant DNA construct can be designed to express multiple miRNA decoys. The advantages of a miRNA decoy approach include the fact that no protein is expressed, and because miRNAs often belong to multi-gene families (wherein each miRNA gene produces a unique miRNA primary transcript) that a single miRNA decoy is useful for binding to a mature miRNA that is derived from more than one miRNA gene or primary transcript.

However, an alternative to a miRNA decoy is sometimes preferred, as it is possible for a miRNA decoy that binds to mature miRNAs from more than one miRNA gene to unintentionally affect the expression of a non-target gene. Applicants have disclosed herein additional novel approaches for manipulating a miRNA-regulated pathway by interfering with the binding of the mature miRNA to its target. These approaches generally involve the in vivo (e.g., in planta) expression and processing of a recombinant DNA construct of this invention, and are especially useful for regulating the expression of single (or, where desired, multiple) target genes, and in manipulating gene expression in transgenic plants, resulting in improved phenotypes such as increased yield or biotic or abiotic stress tolerance.

One approach is by using a "cleavage blocker" or "5'-modified cleavage blocker" that is transgenically expressed in a eukaryotic cell and that binds to a miRNA recognition site of a target gene's transcript in a manner that does not lead to cleavage, thereby preventing or decreasing miRNA-mediated cleavage of the transcript by competing with the miRNA for binding to the recognition site. This method controls the rate of post-transcriptional suppression of miRNA target genes by protecting them from being cleaved by miRNA-Ago complex, and decreases or prevents down-regulation of the miRNA target gene. The invention includes analogous cleavage blockers that compete with other small RNAs involved in silencing, e.g., si-RNAs, trans-acting siRNAs, phased RNAs, natural antisense transcript siRNAs, natural antisense transcript miRNAs, or indeed any small RNA associated with a silencing complex such as RISC or an Argonaute or Argonaute-like protein.

Another approach is by using a "translational inhibitor" that is transgenically expressed in a eukaryotic cell and that binds to and inhibit translation of the target gene's transcript, thereby decreasing expression of the target gene. The nucleotide sequence of the translational inhibitor is designed so that the hybridized segment formed between the translational inhibitor and the target gene's transcript imparts to the transcript resistance to cleavage by an RNase III ribonuclease within or in the vicinity of the hybridized segment. Translational inhibitors provide the advantages of reducing the likelihood of transitive small RNAs forming (as can occur in miRNA-mediated degradation of a target gene), and achievement of more controlled regulation of target suppression because the translational inhibitor remains associated with the target gene's transcript (unlike miRNAs, which dissociate from the cleaved transcript and can then bind another transcript molecule). Translational inhibitors can be based on sequences selected from any small RNA associated with a silencing complex such as RISC or an Argonaute or Argonaute-like protein.

One of ordinary skill in the art easily recognizes that the above procedures are equally applicable to situations where the double-stranded RNA that mediates the target gene suppression is other than a miRNA. Thus, various aspects of this invention include analogous recombinant DNA constructs that are processed in vivo or in planta to provide RNA including single-stranded RNA that serve as an "siRNA cleavage blocker", a "trans-acting siRNA cleavage blocker", a "phased small RNA cleavage blocker", a "natural antisense transcript siRNA cleavage blocker", or a "natural antisense transcript miRNA cleavage blocker" (or, in general terms, a "small RNA cleavage blocker"), according to whether the RNase III ribonuclease cleavage that is inhibited is mediated by, respectively, an siRNA, a trans-acting siRNA, a phased small RNA, a natural antisense transcript siRNA, or a natural antisense transcript miRNA (or, in general terms, any small RNA associated with a silencing complex such as RISC or an Argonaute or Argonaute-like protein).

All of the materials and methods disclosed and claimed herein can be made and used without undue experimentation as instructed by the above disclosure. Although the materials and methods of this invention have been described in terms of preferred embodiments and illustrative examples, it will be apparent to those of skill in the art that variations can be applied to the materials and methods described herein without departing from the concept, spirit and scope of the invention. All such similar substitutes and modifications apparent to those skilled in the art are deemed to be within the spirit, scope and concept of the invention as defined by the appended claims.

SEQUENCE LISTING (2067 sequences)

SEQ ID NO: 1 - DNA, 687 bp, Arabidopsis thaliana
atgagaataaggagaagagatgaaaaagagaatcaagaatacaagaaaggtttatggacagttgaagaagacaacatccttatggactatgttcttaatcatggcactggccaatggaaccgcatcgtcagaaaaactgggctaaagagatgtgggaaaagttgtagactgagatggatgaattatttgagccctaatgtgaacaaaggcaatttcactgaacaagaagaagacctcattattcgtctccacaagctcctcggcaatagatggtctttgatagctaaaagagtaccgggaagaacagataaccaagtcaagaactactggaacactcatctcagcaaaaaactcgtcggagattactcctccgccgtcaaaaccaccggagaagacgacgactctccaccgtcattgttcatcactgccgccacaccttcttcttgtcatcatcaacaagaaaatatctacgagaatatagccaagagctttaacggcgtcgtatcagcttcgtacgaggataaaccaaaacaagaactggctcaaaaagatgtcctaatggcaactactaatgatccaagtcactattatggcaataacgctttatgggttcatgacgacgattttgagcttagttcactcgtaatgatgaattttgcttctggtgatgttgagtactgcctttag

SEQ ID NO: 2 - DNA, 21 bp, Arabidopsis thaliana
ctccaccgtcattgttcatca

SEQ ID NO: 3 - DNA, 336 bp, Glycine max
aattcattacattgataaaacacaattcaaaagatcaatgttccacttcatgcaaagacatttccaaaatatgtgtaggtagaggggttttacaggatcgtcctgagaccaaatgagcagctgaccacatgatgcagctatgtttgctattcagctgctcatctgttctcaggtcgcccttgttggactgtccaactcctactgattgcggatgcacttgccacaaatgaaaatcaaagcgaggggaaaagaatgtagagtgtgactacgattgcatgcatgtgatttaggtaattaagttacatgattgtctaattgtgtttatggaattgtata

SEQ ID NO: 4 - DNA, 748 bp, Glycine max
aaaattcattacattgataaaacacaattcaaaagatcaatgttccacttcatgcaaagacatttccaaaatatgtgtaggtagaggggttttacaggatcgtcctgagaccaaatgagcagctgaccacatgatgcagctatgtttgctattcagctgctcatctgttctcaggtcgcccttgttggactgtccaactcctactgattgcggatgcacttgccacaaatgaaaatcaaagcgaggggaaaagaatgtagagtgtgactacgattgcatgcatgtgatttaggtaattaagttacatgattgtctaattgtgtttatggaattgtatattttcagaccaggcacctgtaactaattataggtaccataccttaaaataagtccaactaagtccatgtctgtgattttttagtgtcacaaatcacaatccattgccattggttttttaatttttcattgtctgttgtttaactaactctagctttttagctgcttcaagtacagattcctcaaagtggaaaatgttctttgaagtcaataaaaagagctttgatgatcatctgcattgtctaagttggataaactaattagagagaacttttgaactttgtctaccaaatatctgtcagtgtcatctgtcagttctgcaagctgaagtgttgaatccacgaggtgcttgttgcaaagttgtgatattaaaagacatctacgaagaagttcaagcaaaactctttttggc

SEQ ID NO: 5 - DNA, 336 bp, artificial sequence
  Synthetic construct
aattcattacattgataaaacacaattcaaaagatcaatgttccacttcatgcaaagacatttccaaaatatgtgtaggtagaggggttttacaggatcgtcctgatgaacaatgacggtggagccacatgatgcagctatgtttgctatctccaccgtcatcgtccatcaggtcgcccttgttggactgtccaactcctactgattgcggatgcacttgccacaaatgaaaatcaaagcgaggggaaaagaatgtagagtgtgactacgattgcatgcatgtgatttaggtaattaagttacatgattgtctaattgtgtttatggaattgtata

SEQ ID NO: 6 - DNA, 21 bp, artificial sequence
  Synthetic construct
tgatgaacaatgacggtggag

SEQ ID NO: 7 - DNA, 336 bp, artificial sequence
  Synthetic construct
aattcattacattgataaaacacaattcaaaagatcaatgttccacttcatgcaaagacatttccaaaatatgtgtaggtagaggggttttacaggatcgtcctgatgaacatagacggtggagccacatgatgcagctatgtttgctatctccaccgtctacgtccatcaggtcgcccttgttggactgtccaactcctactgattgcggatgcacttgccacaaatgaaaatcaaagcgaggggaaaagaatgtagagtgtgactacgattgcatgcatgtgatttaggtaattaagttacatgattgtctaattgtgtttatggaattgtata

SEQ ID NO: 8 - DNA, 21 bp, artificial sequence
  Synthetic construct
tgatgaacatagacggtggag

SEQ ID NO: 9 - DNA, 105 bp, artificial sequence
  Synthetic construct
tccagctgctcatttggtctcatgatcactgcggccgcaatacagccatagatcacttgatgtcacgaccaccgtcattgttcatcagatttctctctgcaagcg

SEQ ID NO: 10 - DNA, 21 bp, artificial sequence
  Synthetic construct
gaccaccgtcattgttcatca

SEQ ID NO: 11 - DNA, 336 bp, artificial sequence
  Synthetic construct
aattcattacattgataaaacacaattcaaaagatcaatgttccacttcatgcaaagacatttccaaaatatgtgtaggtagaggggttttacaggatcgtcccgatgaacaatgacggtggagccacatgatgcagctatgtttgctatctccaccgtcatcgtccatcgggtcgcccttgttggactgtccaactcctactgattgcggatgcacttgccacaaatgaaaatcaaagcgaggggaaaagaatgtagagtgtgactacgattgcatgcatgtgatttaggtaattaagttacatgattgtctaattgtgtttatggaattgtata

SEQ ID NO: 12 - DNA, 21 bp, artificial sequence
  Synthetic construct
cgatgaacaatgacggtggag

SEQ ID NO: 13 - DNA, 336 bp, artificial sequence
  Synthetic construct
aattcattacattgataaaacacaattcaaaagatcaatgttccacttcatgcaaagacatttccaaaatatgtgtaggtagaggggttttacaggatcgtccagatgaacatagacggtggagccacatgatgcagctatgtttgctatctccaccgtctacgtccatctggtcgcccttgttggactgtccaactcctactgattgcggatgcacttgccacaaatgaaaatcaaagcgaggggaaaagaatgtagagtgtgactacgattgcatgcatgtgatttaggtaattaagttacatgattgtctaattgtgtttatggaattgtata

SEQ ID NO: 14 - DNA, 336 bp, artificial sequence
  Synthetic construct
aattcattacattgataaaacacaattcaaaagatcaatgttccacttcatgcaaagacatttccaaaatatgtgtaggtagaggggttttacaggatcgtcccgatgaacatagacggtggagccacatgatgcagctatgtttgctatctccaccgtctacgtccatctggtcgcccttgttggactgtccaactcctactgattgcggatgcacttgccacaaatgaaaatcaaagcgaggggaaaagaatgtagagtgtgactacgattgcatgcatgtgatttaggtaattaagttacatgattgtctaattgtgtttatggaattgtata

SEQ ID NO: 15 - DNA, 1065 bp, Arabidopsis thaliana
atggagttgttaatgtgttcgggtcaggccgagtcaggtggttcctcttccaccgagtcttcttcactcagtggtggactcaggtttggtcagaagatctacttcgaggatggatccggatccagaagcaagaaccgggtcaataccgttcgtaagtcgtctaccacggcgaggtgccaagtggaaggttgtagaatggatctaagcaatgttaaagcttattactcgagacacaaagtttgttgcattcactctaaatcatctaaagtcattgtctctggtcttcatcaaaggttttgtcaacaatgtagcaggtttcaccagctttctgagtttgacttggagaaaagaagttgtcgcagaagactcgcttgtcataacgaacgacgaagaaaaccacaacccacaacggctcttttcacttctcattactctcgaatcgctccatctctttacggaaaccccaatgctgcaatgattaaaagcgttttgggagatcctactgcgtggtcaaccgcaagatcagtgatgcagcggcctggaccgtggcagattaatccagttagggaaacccatccacacatgaatgttttatcacatggaagctcaagctttactacatgtccagagatgataaacaacaatagcacagattcaagctgtgctctctctcttctgtcaaactcatacccaattcatcagcagcaacttcagacaccaacaaatacatggcgaccatcttctggtttcgactcgatgatctcattctccgataaggttacaatggctcagccaccgcccatttcaacccatcagccgcccatctcaacacatcagcagtacctcagccaaacttgggaagtcatcgcgggcgaaaagagcaattcacattatatgtctcctgtgagtcaaatctcggagccagcagatttccagataagcaatggcaccacaatgggtggatttgagctgtatcttcatcagcaggttctgaagcaatacatggaacccgagaacacaagagcttatgactcctctcctcaacatttcaattggtctctttga

SEQ ID NO: 16 - DNA, 1182 bp, Arabidopsis thaliana
atggactgcaacatggtatcttcgtcccagtgggattgggagcatttgatcatgtccaatccgtcaaggactgaagatgacagcaaacagctacctactgagtgggaaattgaaaaaggtgaaggaattgaatctatagttccacatttctcaggccttgagagagtcagtagtggctctgccaccagcttctggcacactgctgtatcgaaaagctcacagtcgacctctatcaactcatcatctcccgaagccaaacgatgcaagcttgcatcagaaagttcccctggagattcttgcagcaacatagactttgtccaggtgaaggctcccacagctctcgaggtatccgttgcctcagctgaatcagatctttgtttaaaactaggaaagcggacatactctgaagaatactggggtagaaacaataatgaaatttcagcggtttctatgaagttgttaactccatctgttgtcgctgggaaatccaaattgtgtggtcagagcatgccagtcccgcgttgccaaattgatggctgtgaactggatctctcatctgctaagggttatcatcgtaagcacaaagtctgcgaaaagcattcaaagtgcccaaaagttagcgtgagtggcctggaacgtcggttctgccaacagtgtagcaggttccatgctgtctctgaatttgatgagaagaaacgaagctgccgaaaacgtctttctcatcataatgcgaggcgtcgtaagccacaaggagtattttcaatgaatcccgagagggtgtatgatcgaagacagcatacaaatatgttgtggaatggggtgtcccttaacgcgagatctgaagaaatgtatgaatggggtaataacacttatgatacaaagcctagacaaacggaaaaaagctttactctgagcttccagagaggtaatggctctgaggaccagctggttgctagtagcagccgtatgttctctacatctcaaacctcaggtgggttcccagcaggaaagtccaagtttcaacttcatggcgaagatgtgggagaatactcaggagtcctccatgaatctcaagatatccaccgtgctctctctcttctgtcaacctcttcggatcccctggcccaaccacatgtgcagccattttctctactctgttcatatgatgttgtaccaaaatag

SEQ ID NO: 17 - DNA, 1080 bp, Arabidopsis thaliana
atggactggaatttcaaacttagctctggttatttatctggattcgatcaagaaccagatttatcaccaatggatggttcgatctcgtttggtgggtcgtcacagtcaaaagcggatttttcatttgatctaaaacttggaagaaacattggaaactcttcctctgtttttggtgatacagagcaagtgattagtcttagtaagtggaaagatagtgctttagctaaaccagaaggttcaagaagctcgagttcaaagagaacaagagggaatggtgttggaaccaaccagatgccgatttgtcttgttgatggatgtgattctgattttagtaattgtagagagtatcataagagacataaagtttgtgatgttcattcaaaaactcctgtggttactattaatggtcataaacagaggttttgtcaacaatgcagcaggtttcatgctttggaggagtttgatgaagggaagagaagttgtaggaaacgtcttgatggacataatcgaagacgacggaagccgcagcctgaacatatcggtcgtcctgccaacttctttacgggttttcaaggtagcaaattgctagagttttctggtggttcacatgtgtttccaactacatctgtgttgaacccgagctggggaaatagtcttgtaagcgttgctgtagccgccaatggttcgagttatgggcagagccagagctatgttgttggttcttctcctgcaaagacagggataatgtttccaatctcttcttctccaaacagtaccagaagcatagcaaaacaattccctttcttgcaagaagaagaaagctcgagaaccgcatcgttgtgtgagagaatgacgagttgcatccatgactctgattgtgctctctctcttctgtcatcctcctcgtcgtcagtccctcatttgcttcaaccaccactttctttgtcccaagaagcagttgagacagttttttacgggtcgggattgtttgagaatgcgagtgcagtctctgatggatcggttatatccggtaacgaggctgtccgtcttccgcagacattcccgtttcattgggagtag

SEQ ID NO: 18 - DNA, 1065 bp, Arabidopsis thaliana
atggagttgttaatgtgttcgggtcaggccgagtcaggtggttcttcttccaccgagtcttcttcactcagtggtggactcaggtttggtcagaagatctacttcgaggatggatccggatccagaagcaagaaccgggtcaataccgttcgtaagtcgtctaccacggcgaggtgccaagtggaaggttgtagaatggatctaagcaatgttaaagcttattactcgagacacaaagtttgttgcattcactctaaatcatctaaagtcattgtctctggtcttcatcaaaggttttgtcaacaatgtagcaggtttcaccagctttctgagtttgacttggagaaaagaagttgtcgcagaagactcgcttgtcataacgaacgacgaagaaaaccacaacccacaacggctcttttcacttctcattactctcgaatcgctccatctctttacggaaaccccaatgctgcaatgattaaaagcgttttgggagatcctactgcgtggtcaaccgcaagatcagtgatgcagcggcctggaccgtggcagattaatccagttagggaaacccatccacacatgaatgttttatcacatggaagctcaagctttactacatgtccagagatgataaacaacaatagcacagattcaagctgtgctctctctcttctgtcaaactcatacccaattcatcagcagcaacttcagacaccaacaaatacatggcgaccatcttctggtttcgactcgatgatctcattctccgataaggttacaatggctcagccaccgcccatttcaacccatcagccgcccatctcaacacatcagcagtacctcagccaaacttgggaagtcatcgcgggcgaaaagagcaattcacattatatgtctcctgtgagtcaaatctcggagccagcagatttccagataagcaatggcaccacaatgggtggatttgagctgtatcttcatcagcaggttctgaagcaatacatggaacccgagaacacaagagcttatgactcctctcctcaacatttcaattggtctctttga

SEQ ID NO: 19 - DNA, 2013 bp, Arabidopsis thaliana
atgataaatgtgatgaatccaatgaaaggtggaacagagaaaggtttagatcctcagctatggcatgcatgtgctggtggtatggttcgtatgcctcctatgaactctaaagtcttttactttcctcaaggtcacgccgaaaacgcttacgattgtgtcgatttcggtaatctccctattcctcccatggttttgtgtcgtgttttagccattaagtatatggctgatgctgaatctgacgaggttttcgctaaactgagattgattcctttgaaagatgatgagtatgttgatcacgagtatggtgatggtgaagatagtaacggtttcgagagtaatagtgagaaaacgccttcgtttgctaagactttgactcagtctgatgctaataacggtgggggtttctctgttcctcgttattgcgctgagacgattttcccgaggttggattataacgccgagccgccggttcagaccattcttgctaaggatgttcatggtgatgtttggaagttcagacatatttatagagggacgcctcggcgtcaccttcttacaaccggatggagtaattttgtaaaccagaagaagcttgtggcgggagattcgattgtcttcatgagagcggagaatggagatctttgtgtaggtattaggagggctaagagaggagggataggtaatggacccgaatattcagcgggttggaatccgatcggtggaagttgcggctactcttctctgttaagggaagatgaaagcaatagtttgaggagaagtaattgttcccttgcggataggaaggggaaagtgacggctgaatctgttatagaagcagccactcttgctattagcggaagaccgtttgaggttgtgtactatccgagagctagcacttcagagttttgtgtcaaggcattagatgctcgagctgccatgcggattccgtggtgctcaggtatgaggtttaagatggcttttgagacagaggattcgtctcggataagttggtttatggggactgtttcagctgttaatgtctctgatcctatccgttggcctaactctccttggcggcttctacaggtggcgtgggatgagccagatttactccaaaacgtgaagcgagttaacccgtggttggtggaattggtatcaaacgtacatccgatcccgcttacttcgttttcgccaccgaggaaaaagatgcggctacctcagcatccagattacaacaatctgatcaattcgattccagtaccttcattcccaagcaatccccttattagatcaagcccgttaagctctgttctggacaatgttcccgtgggtttacagggagccaggcataatgctcatcagtactacgggttatcatcttcggatcttcaccattactacttgaatagaccacctcctcctcctcctccatcctctctccaactttctccttctctcggtctccgaaacatcgataccaaaaacgaaaaaggattttgctttttgacaatgggaacaacaccatgcaatgataccaaatctaaaaagtcccatattgtattgttcggcaagcttatactacccgaggaacagctatcagaaaaaggctcaacggataccgcaaacatagagaaaacgcagatttcatcaggcgggtcgaaccaaaacggcgttgcgggaagggagttttcttcgtcagatgaaggatcaccttgctctaagaaagttcatgatgcatcaggtttggaaacagggcattgtaaagtgtttatggagtcagacgatgtaggtcgaaccttagacctatcggttcttggttcatacgaagaattgagtcggaaactctctgacatgtttggaatcaaaaagtctgagatgttaagctctgttctctatagggatgcatcaggagccatcaaatacgcaggaaacgaacctttcagtgagttcttgaagacagctcgaagattgacaattctgacggaacaaggaagtgagagcgttgtagtataa

SEQ ID NO: 20 - DNA, 858 bp, Arabidopsis thaliana
atggattacgaggcatcaagaatcgtcgaaatggtagaagatgaagaacatatagatctaccaccaggattcagatttcaccctactgatgaagaactcataactcactacctcaaaccaaaggttttcaacactttcttctctgctactgccattggtgaagttgatctcaacaagattgagccttgggacttaccatggaaggctaagatgggagaaaaagaatggtatttcttctgtgtgagagaccggaaatacccgaccggtttaaggacaaaccgggcgacagaagccggttattggaaagccacaggaaaagacaaagagatattcaagggaaaatcacttgtgggtatgaagaaaactttggttttctataaaggaagagctcctaaaggagttaaaaccaattgggttatgcatgaatatcgtttagaaggcaaatattgtattgaaaatcttccccaaacagctaagaacgaatgggttatatgtcgtgttttccaaaaacgtgccgatggtacaaaggttccaatgtcaatgcttgatccacacattaaccgaatggaaccagccggtttaccttcgttaatggattgttctcaacgagactccttcaccggttcgtcgtctcacgtgacctgcttctccgaccaagaaaccgaagacaaaagacttgtccacgagtccaaagacggttttggttctctgttttactcggatcctctgtttttacaagacaattattcgctaatgaagctgttgcttgacggtcaagaaactcaattctccggcaaacctttcgacggtcgtgattcgtccggtacagaagaattggattgcgtttggaatttctga

SEQ ID NO: 21 - DNA, 972 bp, Arabidopsis thaliana
atggagacggaagaagagatgaaggaaagtagtataagcatggtggaggcaaagttgcctccgggattcagatttcacccgaaggacgatgagcttgtctgcgattacttgatgagacgatcgcttcacaataatcatcgaccacctcttgtcctgatccaagtcgatctcaacaagtgtgagccttgggacatcccaaaaatggcatgcgtgggagggaaggattggtatttctacagccaaagagaccgaaaatacgcgacggggctgagaactaaccgagcaacggccaccggatattggaaagccaccggcaaagacagaaccattctaagaaagggtaagctagttgggatgaggaagacattggttttctatcaaggtcgagctcctcgaggccgtaaaaccgattgggtcatgcacgaattccgtctccaaggatctcatcatcctcccaatcattctctgagctctccaaaggaagactgggtcttgtgtagggtattccataagaatacggaaggagttatatgtagagacaacatgggaagctgttttgatgagacagcctctgcatcgcttcctccactgatggatccttacatcaactttgaccaagaaccctcttcttatctcagtgatgatcatcactacatcatcaatgagcacgtaccctgcttctccaatttgtcacagaaccaaaccttaaactcgaacctaaccaactcagtctctgaactcaagattccatgcaagaaccctaaccccttgtttactggtggttcagcctcagccacgctcacaggcctcgactcattctgttcttcagatcagatggttctcagagctctactcagtcagctcactaagattgatggaagcctcgggcctaaagaatcacagagttatggagaaggtagctcggagagcctcctgaccgacatcggtattccaagcactgtttggaattgc

SEQ ID NO: 22 - DNA, 2484 bp, Arabidopsis thaliana
atgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtgtga

SEQ ID NO: 23 - DNA, 2526 bp, Arabidopsis thaliana
atggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcccggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtg

SEQ ID NO: 24 - DNA, 2526 bp, Arabidopsis thaliana
atggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtg

SEQ ID NO: 25 - DNA, 2529 bp, Arabidopsis thaliana
atggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtgtga

SEQ ID NO: 26 - DNA, 2526 bp, Arabidopsis thaliana; identical to SEQ ID NO: 24

SEQ ID NO: 27 - DNA, 2526 bp, Arabidopsis thaliana; identical to SEQ ID NO: 24

SEQ ID NO: 28 - DNA, 2526 bp, Arabidopsis thaliana
atggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgccggggatgaagcctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtg

SEQ ID NO: 29 - DNA, 2526 bp, Arabidopsis thaliana
atggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcctggtccagattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtg

SEQ ID NO: 30 - DNA, 2526 bp, Arabidopsis thaliana
atggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaaacctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtg

SEQ ID NO: 31 - DNA, 2526 bp, Arabidopsis thaliana
atggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctggcatgaagcctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtg

SEQ ID NO: 32 - DNA, 2526 bp, Arabidopsis thaliana
atggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcctggcccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtg

SEQ ID NO: 33 - DNA, 2526 bp, Arabidopsis thaliana
atggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctggcatgaagcctggtccagattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtg

SEQ ID NO: 34 - DNA, 2526 bp, Arabidopsis thaliana
atggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaaacctggtccagattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtg

SEQ ID NO: 35 - DNA, 2526 bp, Arabidopsis thaliana
atggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaaacccggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtg

SEQ ID NO: 36 - DNA, 2433 bp, Arabidopsis thaliana
atgaagctgtcaacatctggattgggtcaacagggtcatgaaggagagaagtgtctgaattctgagctatggcatgcttgtgctggaccattagtctctcttccatcatctggtagtcgagttgtttactttccacagggtcacagtgaacaggtagctgctacaactaataaggaagttgatggtcacatacccaattacccaagcctaccaccacaattgatatgccagctccataatgttacaatgcatgcagatgttgagacggatgaagtctatgctcaaatgacacttcaaccattgacaccggaggagcagaaggaaacatttgtaccgattgagttggggataccgagtaagcaacctagtaattatttttgtaagactctcacagctagtgataccagtacacatggagggttttctgttcctagacgtgctgctgagaaagtgtttcctccattggattacacactgcagccaccagctcaagaactgattgcaagggatctccatgatgttgaatggaagtttaggcatatctttcggggacagcccaaacggcatctcctaactactggatggagtgtctttgtcagtgccaagcgactagtagctggagattctgtcattttcatcaggaatgaaaagaatcaactctttttgggaattcgtcatgccactcggccgcagactattgtaccatcatctgttttatctagtgatagcatgcatattggactccttgctgctgctgcacatgcttctgcaactaatagctgtttcactgttttctttcatccaagggctagccaatctgagtttgtgatacaactttccaagtacattaaagccgtttttcacacgcgtatttcagttgggatgcgctttcgcatgctcttcgagacagaagagtcgagtgtccgcaggtacatgggtactataactggtattagtgatctagattctgttcgttggccaaactctcattggcgatctgtgaaggttggttgggatgaatcgactgcaggggagagacagccaagggtttctttatgggagattgagcctctgactacctttcctatgtatccatctctttttcctctcagactaaaacgtccatggcatgctggcacatcatctttgcctgatggaaggggtgatttgggaagtggtctaacatggctaagagggggaggtggagagcagcaaggtttgcttcctctaaattatccatctgttggtttgtttccatggatgcaacaaaggctggatctcagtcaaatggggactgataataatcagcaataccaagcaatgttagctgctgggttgcagaacatcggcggtggagatcctttaagacagcagtttgtacagctgcaagagcctcaccaccaatatcttcaacaatcagcttcccataattctgatttgatgcttcagcagcaacagcagcaacaagcgtcacgccatctcatgcatgctcaaacacagattatgagtgagaatcttccgcagcagaatatgcgacaagaagttagtaaccaaccagctggacagcagcaacagctacagcaaccggaccaaaatgcatatcttaatgctttcaaaatgcaaaatggccatcttcaacagtggcagcagcaatcagagatgccatctccctcgttcatgaagtcagattttactgactcaagcaacaaatttgcaacaactgctagtccggcttctggagatggcaatcttttgaatttttctataaccggtcagtctgtactccctgagcagttaacaacagagggctggtctccaaaagcatccaacactttttctgaaccgttgtcacttccacaagcctatcctgggaagagtcttgctctagaacccggaaatccgcagaatccctctcttttcggtgttgatcccgactctggactcttcctccccagtacggttccccgctttgcttcttcatcaggagatgctgaagcttcccctatgtcactaacagattcaggatttcagaattccttatatagctgcatgcaagacacaactcatgagttattgcatggagctggacagattaactcgtccaaccaaaccaagaactttgtaaaggtttataaatctggttcggttgggcgttcattagacatctcccgattcagcagctaccacgagctgcgagaagagttagggaagatgtttgctatcgaagggttgttggaagacccccttagatcaggctggcagcttgtattcgttgacaaggaaaatgatattcttctccttggtgatgacccatgggagtcatttgtgaataacgtttggtacataaagatactatcaccagaagatgtgcatcaaatgggagatcatggagaaggcagtggtgggttattcccgcaaaacccgacccatctc

SEQ ID NO: 37 - DNA, 1347 bp, Arabidopsis thaliana
atgttggatcttaacctcaacgctgattctcccgagtcgactcagtacggtggtgactcatacttagatcggcagacatcagacaactccgccgggaatcgagtggaagagtccggtacatcgacgtcgtcagttatcaatgccgatggagacgaagactcttgctctactcgagctttcactctcagtttcgatattttaaaagtcggaagtagtagcggcggagacgaaagccccgccgcttcagcttccgttactaaagagttttttccggtgagtggagactgtggacatctacgagatgttgaaggatcatcaagctctagaaactggatagatctttcttttgaccgtattggtgacggagaaacgaaattggtaactccggttccgactccggctccggttccggctcaggttaaaaagagtcggagaggaccaaggtctagaagttcacagtatagaggagttactttttatagaagaactggtcgatgggagtcacatatttgggattgtgggaaacaagtttatttaggtggtttcgacactgctcatgctgcagctagagcttatgatcgagctgctattaaatttagaggtgttgatgctgatatcaactttactcttggtgattatgaggaagatatgaaacaggtacaaaacttgagtaaggaagagtttgtgcatatactgcgtagacagagcacggggttttcgcgggggagttcgaagtatcgaggggttacgttacacaaatgtggtagatgggaagctaggatggggcagtttcttggtaaaaaggcttatgacaaggctgcaatcaacactaatggtagagaagcagtcacgaacttcgagatgagttcataccaaaatgagattaactctgagagcaataactctgagattgacctcaacttgggaatctctttatcgaccggtaatgcgccaaagcaaaatgggaggctctttcacttcccttctaatacttatgaaactcagcgtggagttagcttgaggatagataacgaatacatgggaaagccggtgaatacacctcttccttatggatcctcggatcatcgcctttactggaacggagcatgcccgagttataataatcccgccgagggaagagcaacagaaaagagaagtgaagctgaagggatgatgagtaactggggatggcagagaccggggcaaacaagcgccgtgagaccgcagccaccgggaccacaaccaccaccattgttctcagttgcagcagcatcatcaggattctcacatttccggccacaacctcccaatgacaatgcaacacgtggttacttttatccacaccct

SEQ ID NO: 38 - DNA, 1458 bp, Arabidopsis thaliana
atgctggatctcaatctcgacgtcgactcgaccgagtctactcagaacgaacgagattcgattactgttaaaggggtttctttgaatcagatggatgaatcggtgacgtcgaactcttctgttgttaatgctgaagcttctagctgtatagatggtgaagatgagttgtgctctacacgaacggtcaagtttcaatttgagatactgaaaggaggaggagaagaagaagaagaagatgatgatgaaagaagtgctgtgatgatgactaaggagttttttcctgttgctaaaggcatgaactttatggattcgagcgctcaaagttcaaggagcaccgttgatatttccttccagagggggaaacaaggtggagactttataggtagcgggagcggtggtggcgatgcttcacgggtgatgcagccaccatcacagccggtgaagaaaagcaggagaggtcctaggtctaagagttctcagtatagaggcgtcactttctatcggaggacaggcagatgggaatcgcatatctgggattgcggtaaacaagtttatttaggtggatttgatactgcccatgctgcagctagggcgtatgatcgagctgctgtcaaattccggggtctggaagctgacatcaatttcgttattggcgattatgaagaggatctcaagcagatggcgaatctttccaaagaggaagttgtgcaagtacttcggcgacagagctctggtttctcaaggaataattctagatatcaaggagttgctttgcaaaagattggcgggtggggagctcaaatggagcagcttcatggaaacatgggttgtgacaaggcagccgtacaatggaagggaagggaagctgcttccttaattgagcctcatgcatcccgaatgattcccgaggcagctaatgttaagctcgacctcaacttgggaatctctctttcactaggagatggtccgaagcaaaaagatagggccctccggcttcaccatgtccctaacaattccgtatgtggaaggaacaccatgatggagaaccacatggctgcagcggcatgtgatacgcctttcaatttcttgaagaggggttcagaccatcttaataaccggcatgcccttccttctgcgttcttttcacccatggaaagaacaccagagaaagggcttatgttacgttctcatcaaagcttcccagccaggacatggcaagggcatgatcagtccagtggtgggaccgccgtagcagctacagcaccgccactgttttcaaatgcagcatcatcaggattctcactctcagctacacgccctccttcatccacagctattcatcatccttctcagcccttcgtcaatctgaatcagcccggtctctatgttatccacccatctgattacatatctcagcaccaacacaatctcatgaaccgcccacaaccaccaccatag

SEQ ID NO: 39 - DNA, 1734 bp, Arabidopsis thaliana
atgaattatttcccagacgaggttatagagcacgtgtttgacttcgtagcttctcacaaagacaggaactcgatatctctggtctgcaaatcatggcacaagatcgagaggtttagtaggaaggaagtgttcatcggaaactgctacgcgattaacccggagaggttgatcaggaggtttccatgtctcaaatccttaactttaaaagggaagcctcattttgcagacttcaacttggttcctcatgaatggggaggtttcgtgcatccttggattgaagctttggctagaagccgtgtgggacttgaggagctgaggttgaagcggatggttgtaacagatgaaagcttggaccttctttcacgttcttttgcaaatttcaagtctttggttcttgttagctgtgaagggtttaccactgatggcttagcttccattgccgctaattgcaggcatcttcgtgagctggacttgcaagagaatgagattgatgatcatagaggtcaatggctgaactgttttccagatagctgcactactcttatgtcgttgaatttcgcttgccttaaaggagagaccaatgttgctgctttagaaaggcttgttgctaggtcaccaaacctgaagagcttgaagttaaaccgtgcagtaccgcttgacgcactcgcaaggttaatgagttgtgcgccgcagctagtggacttaggagtagggtcttatgagaatgagccagatcctgaatcttttgcaaaactcatgactgccattaagaaatacacatcgttaaggagcttgtctggctttttagaggttgctccactctgcctcccagcgttctacccaatttgccaaaaccttatctctttgaacctcagctatgcagctgaaatccaaggcaaccacctcattaagcttattcagctttgcaagagacttcaacgattatggatattggatagtattggtgacaaaggacttgcggttgtcgctgccacatgtaaagagttacaagagcttagagtttttccctctgatgtacatggtgaagaagataacaacgcatctgtgactgaggttggactagtcgccatttccgcaggttgccctaaacttcattcgattctgtacttctgcaaacagatgacaaacgcagcgctcatagccgtggccaaaaactgtccaaacttcatccggttcaggctatgcattctcgagccacacaaacctgaccacattacatttcaatcactggacgagggctttggtgcaatcgtacaagcttgcaagggtctaagacggctctctgtctccggtctcttaaccgatcaagtctttctctacatcggtatgtacgcggaacagctcgagatgctttcgatagcttttgcgggggacactgacaaaggaatgctctatgtgttgaatggatgcaaaaaaatgaggaagctggagataagggacagtccttttgggaacgctgcgcttcttgctgacgtgggtaggtacgaaacaatgcgatccctttggatgtcgtcttgtgaagtaacactcggtggctgcaagaggctcgcgcagaattcgccacggcttaacgtagagatcatcaacgagaatgagaataatgggatggaacagaatgaagaagatgaaagagagaaggttgataaactttacctctaccgaacagtggttgggactagaaaagatgcaccaccatatgttaggattctttag

SEQ ID NO: 40 - DNA, 1728 bp, Arabidopsis thaliana
atgaattatttcccagatgaagtaatagagcatgtattcgactttgtaacatctcacaaagacaggaatgctatatctcttgtatgcaaatcatggtacaagattgaaagatacagtaggcaaaaggttttcattggaaactgttatgccattaatccagagaggttgcttcggagattcccatgtctaaagtctttgactttgaaaggaaaacctcattttgcggatttcaatttggttcctcatgaatggggaggttttgtgctaccttggattgaggctttggctagaagccgtgtaggacttgaagagcttaggttgaagaggatggttgttactgatgagagtcttgagctgctttctcgttcttttgtcaattttaagtctttggtccttgttagctgtgaaggttttaccactgatggtcttgcctctattgccgctaattgcaggcatcttcgggatcttgatttgcaagagaatgaaatcgatgatcatagaggtcaatggttaagttgtttcccagacacttgcacgactcttgtcacgctaaactttgcgtgcctcgaaggagaaactaatctggttgctctagagaggcttgttgctaggtctccaaacctaaagagtctgaagctaaatcgtgcagtaccgttagatgcactcgcaaggttaatggcgtgtgcgccgcagatagttgacttaggagtagggtcttatgagaatgacccagattccgagtcttacttgaaactcatggctgtcataaagaaatgcacctcgttgaggagtttgtcgggttttctagaggctgctcctcactgtctctcagctttccacccaatatgtcataacctcacctccttgaatcttagttacgcagctgagattcatggtagccaccttattaagcttattcagcattgcaagaaacttcagcggttatggattttggatagtataggtgacaaagggcttgaagttgtagcttctacatgtaaagagttacaagagcttagggtttttccatctgatttactcggtggaggcaacacagctgtgaccgaagaaggtctagttgccatctcggcaggctgccctaagctccactctatactctacttctgccaacaaatgacaaacgcagctctcgtaaccgttgccaagaactgtccaaatttcatccgtttccgactctgcatcctcgagccaaacaaacccgatcacgtcacatctcaacctctagacgaaggctttggagcaatcgtcaaagcctgcaagagcctgagaaggctttctctctcaggtctccttacagaccaagtcttcctctacatcggaatgtacgcgaatcagctcgagatgctctccatagcctttgcaggagatacagacaaaggcatgctatatgtgttgaatggttgcaaaaagatgaagaaactagagataagggatagtccgtttggggacacggcgcttcttgctgatgtgagcaagtatgaaacaatgcgatccctttggatgtcttcatgtgaagtcacactcagtggatgcaaaaggctcgcagagaaagcgccatggctcaatgtagagatcataaacgagaatgataataaccggatggaagaaaacggacacgaggggaggcagaaagtggataagttgtatctgtaccggactgtggttgggacaagaatggatgcgccgccatttgtgtggattctctaa

SEQ ID NO: 41 - DNA, 1758 bp, Arabidopsis thaliana
atgggtctccgattcccacctaaggtgttggaacatatcctctccttcattgattccaacgaggaccggaactctgtttctctggtctgcaagtcatggtttgagacagaacggaagactaggaagcgagtctttgtcggaaactgttacgcggtcagtcctgctgcggttacacgacggttcccggagatgagatctttgactttgaaggggaagccacacttcgctgactataatctcgttcctgatggttggggtggttatgcttggccgtggattgaagctatggcggcgaaaagttcgtctcttgaagagatcagaatgaagaggatggtggtgactgatgagtgcttagagaaaattgctgcttcgtttaaggattttaaagtccttgtgttgacttcttgtgaaggtttctctactgatggtatcgctgctattgcagctacttgcaggaacttgagagtgttggaactacgagagtgtattgttgaagatttaggaggagattggcttagctattttccagagagttcaacttctttggtctctcttgacttctcttgtttagattctgaggttaaaatctcggatttagagcgtcttgtgagcagatctccaaacttgaagtctttgaagttgaatccagctgtgactctagatggactcgttagcttacttcgttgtgctccacaactgactgagctcggcacaggttctttcgcagctcaattgaaacctgaagcgttttcaaagttatcagaagctttttcaaactgtaagcaacttcagagcttatctggtctctgggatgtcctccctgaatatcttccagctctttattctgtctgtcctggtcttacctcgttgaacttgagctacgctactgtccgaatgcctgatcttgttgagcttcttaggcgatgctcgaaactgcagaagctatgggtgatggacttgattgaggacaaaggtcttgaagctgttgcctcatattgcaaggaactgcgagaactgagggtgtttccatctgagccagatcttgatgcaaccaacatacctctgacggaacaaggcctggtctttgtgtctaaaggctgtcgaaagcttgagtctgttctctacttctgtgtccagttcacaaacgcagctttgtttaccatagcaagaaaacgtccgaatctcaagtgcttccgtctctgtgtgatagagccatttgctcctgattacaaaacaaatgagccacttgataaaggattcaaagccatagctgagggatgcagggatcttcgacggctctccgtctctggtcttctctctgacaaggccttcaaatacattgggaaacatgccaagaaggttaggatgctatcaatagcatttgctggggacagtgatttgatgcttcatcacttgttgtcgggctgtgagagtttaaagaagcttgagatacgagactgcccttttggagacactgcactactggagcacgctgccaagctagagaccatgcgatccctttggatgtcatcttgctttgtaagttttggtgcttgcaagcttctaagtcagaaaatgccaaggctcaatgtcgaagtcattgatgaacatcctccagagtcaagacctgagagctctccagttgagaggatatacatatacagaacagtcgcaggaccgagaatggatacgcctgaatttgtgtggacgatacacaagaatcctgagaatggagtttcacatctagccataaagtaa

SEQ ID NO: 42 - DNA, 1785 bp, Arabidopsis thaliana
atgcagaagcgaatagccttgtcgtttccagaagaggtactagagcatgtgttctcgtttattcagctggataaggataggaactcagtctctctggtgtgcaagtcatggtacgagatcgagcggtggtgcaggaggaaagtcttcatcgggaactgctacgccgtgagtccagcgacggtgattaggaggttcccgaaagtgagatccgtggagcttaaaggaaaacctcactttgctgactttaatttggtacctgacggatggggaggttacgtgtatccatggattgaggccatgtcttcgtcttacacgtggcttgaagagataaggctgaagaggatggtggtcaccgacgattgcttggagctcatagccaagtcttttaagaattttaaggttcttgtgctttcttcctgcgaaggcttctccaccgatggtctcgctgctatcgctgccacttgcaggaatctgaaagagcttgacttacgagagagtgatgttgacgacgttagtggccactggcttagccatttcccagatacatacacttctttggtatcactcaatatatcttgcttagcatctgaggtcagtttctctgctctggaaaggctggtgactaggtgtcccaatctcaagtctctcaagcttaaccgagctgttccacttgaaaaattggctactttacttcaaagagcacctcaattggaggaattgggcactggtgggtacactgcagaagtgcgaccagatgtttactctggtttatctgtagcgctctctgggtgcaaggaattgaggtgcttatctggattttgggatgctgttcctgcctatcttccagcagtttattcggtttgcagtcggcttacaactttgaatctgagttatgcaacagtccagagctatgatcttgtcaagcttctttgtcaatgccctaaactgcagcgcctctgggtgcttgactacatcgaggatgctggtcttgaggtgcttgcttcaacctgcaaggacctacgcgagctgagagtgtttccgtccgagccttttgtcatggaaccaaatgtggcattgacggaacaggggcttgtctccgtctccatgggctgtccaaaactcgagtcggttctctacttctgccgtcaaatgaccaatgctgcattgataaccattgctaggaaccgtcccaacatgactcgcttccgtttgtgcatcattgagccaaaagccccagactatctgactctagagccactggatattggatttggagccatagtagagcactgcaaggatctccgtcgcctctctctatctggcctcttgaccgacaaggtttttgaatacattgggacatatgccaagaagatggaaatgctctcagtggcatttgcaggagacagtgacttaggcatgcatcatgttttgtccgggtgcgatagcttgaggaaactagagataagggactgcccgtttggagacaaggcgcttttggccaatgcttcaaagctggagacaatgcgatccctttggatgtcttcttgttccgtgagttttggagcctgcaagttactaggacagaagatgccaaagctgaatgtggaagtcatcgatgaacggggtgcaccggactcgagaccagagagctgccctgttgagagagtcttcatataccgaacagtggctggtcctcgatttgacatgcctggcttcgtctggaacatggaccaagactcaacaatgaggttttccaggcaaatcattactactaacggattataa

SEQ ID NO: 43 - DNA, 1608 bp, Arabidopsis thaliana
atggatattggtgttcatgttcttgggtcggttactagtaatgaaaatgagtcacttggtctaaaagagcttataggaactaaacaagatagatccggattcatcggtgaggattgcttgcaacgaagcttgaagctagcaagaacgacaactagagcggaagaagaagaaaacttgtcttcttctgttgcagctgcttattgcaaaacgatgtcgtttcaccaaggcattcctctcatgagatctgcttctcctctttcctctgattctcgccgtcaagaacaaatgcttagcttctcagataaaccagacgctcttgatttcagtaaatatgtcggtttggataatagcagtaataacaagaactctctctcgccgtttcttcaccagattcctccaccttcttactttagaagctcaggaggatatggttctggtggaatgatgatgaacatgagcatgcaagggaacttcacaggtgttaaaggaccttttacattgactcaatgggctgagttagagcaacaggcgttgatctataagtacatcacagccaatgtccctgttccttctagtttgctcatctctatcaagaagtctttttatccttacggatctttgcctcctagttccttcggatggggaactttccatctcggtttcgcaggcggtaacatggaccctgagccagggagatgccgcagaacagatgggaagaaatggcggtgctcaagagacgccgttcctgatcagaaatactgtgaaagacacatcaacagaggccgtcatcgttcaagaaagcctgtggaagtccaatctggccaaaaccaaaccgccgctgctgcatccaaagcggttactacaccacaacagcctgttgtcgctggtaatactaacagaagcaatgcccgtgcatcaagcaaccgcagcctcgccattggaagtcaatatatcaatccttctacagaatctttacctaacaacagaggagtttcgatatatccttccaccgtcaacttacaacccaaggaatctccggttattcatcagaaacacagaaacaacaacaacccttttgagtttggacacaaatcctctgattcgttactcaacccgaataccgcaaagacctatggatcatcgttcttggatttcagcagcaaccaagagaagcattcagggaatcacaatcacaattcttggcctgaagagctgacatcagattggacacagctctcaatgtcaattccaatagcatcatcatccccttcctccacacacaacaacaacaatgctcaagaaaaaacaacactctcgcctctcaggctatcccgcgagcttgacctatcgatccaaaccgatgaaacaacaatcgagcctactgtgaaaaaggtgaatacttggataccaatctcatggggaaactccttaggaggtcctctaggtgaagtactaaacagtacaacgaatagtccaacatttggatcttctcctacaggggttttgcaaaagtccacattttgttcactctctaacaacagctccgtgagcagccccattgcagagaacaacagacacaatggcgattactttcattacacaacctga

SEQ ID NO: 44 - DNA, 2385 bp, Arabidopsis thaliana
atggtacattcagagtcatcaatacttagttccttgcgcggtggtgatggcggtggtattccttgttctaaggatgaactagcaataaatggtagttacaccgatcctatggggcggaggaagtccaagcggtttaaggttgctgcggaaagtgagttttcacctgattttggatcgattaccaggcagctcagatcgagaagaatgcagaaggagttcacagttgagacttacgagaccaggaatgtttctgatgtttgtgttctctcttctcaagctgatgttgagttgattcctggagaaattgttgcagaaagagatagctttaagtcggttgattgtaatgacatgtcggttgggttaaccgaaggagctgaatctcttggagttaacatgcaagaacctatgaaagataggaatatgccagagaacacaagtgagcaaaatatggtggaggtccatcctccaagcataagcctgccagaggaagatatgatggggtctgtttgcaggaaaagcatcactggaacaaaggagcttcacggaagaacgatctctgttgggagagacttatctccaaatatggggagcaagttttcaaagaatggaaagaccgctaaacgttctatatcggtggaagaggaaaacttggttctggagaagtcagattctggagaccatttgggtccatcaccagaggttttggaacttgagaaatcagaggtttggataattacagacaaaggggttgtaatgccttcaccagtgaagccttccgagaagaggaatggagattatggtgaaggatctatgaggaagaatagtgagagggttgccctggataaaaagagattagctagtaaatttcggttatcaaatggtgggcttcctagttgctcaagcagtggggatagtgctcggtataaagttaaggaaacaatgcgtcttttccatgaaacttgtaaaaaaattatgcaagaggaagaagcaaggcctaggaaaagagatggtggcaatttcaaagtggtttgcgaggcttcgaaaattctcaagagtaaagggaaaaatctttatagtggtactcagattattggaactgtgcctggtgttgaggttggcgatgaatttcaatatagaatggagctgaaccttcttggtatacatagaccaagtcaaagtggtatcgactatatgaaagatgacggtggggaactagttgccacgagtattgtatcctcgggaggttataatgacgtgcttgataactctgatgtcttgatctacacgggtcaaggcggaaatgtggggaaaaagaaaaataatgaaccacccaaagaccagcagcttgtaacgggaaaccttgcgttgaaaaacagtataaacaaaaagaaccctgtgcgggtcataagaggcatcaaaaatacgacattacaatcatcagttgttgcaaagaattatgtttacgatggattgtatctggtggaagagtactgggaagaaaccgggtctcacggtaaactcgtcttcaagttcaaactacggcgtattcctggacaacccgagcttccctggaaagaggttgcgaaatcgaaaaaatctgagttccgggatggtctttgcaatgttgatatcacagaagggaaagagacattacccatatgcgctgtgaacaatttagacgatgagaaaccgccaccgtttatctacacggctaaaatgatatatccggattggtgccggccaattcctccaaagagctgcggttgcacaaacggctgctccaagtcaaaaaactgtgcctgcattgtgaaaaacggtggaaagataccttattacgatggagccattgttgaaattaagcccctggtctatgagtgtggcccacactgcaaatgcccaccttcttgcaacatgagagtctcacagcacgggatcaagatcaagctggagatcttcaaaacggagtcaagaggttggggagtgagatcgctggaatctattcctatcgggagcttcatctgtgagtacgcaggagagcttctagaggataaacaagctgaaagccttaccgggaaagatgagtatctttttgatctcggggacgaggatgatccgttcaccataaacgcagcacagaaagggaacatagggaggtttataaaccatagctgctcgccgaatctgtacgcacaggacgtattgtacgaccatgaggaaataagaatacctcacattatgttctttgcactggacaatatacctccacttcaggaactctcgtacgactacaattataagatcgatcaggtatacgactctaatggtaatatcaagaagaaattttgctattgtggttccgctgagtgtagtggtaggctctactaa

SEQ ID NO: 45 - DNA, 3111 bp, Arabidopsis thaliana
atggtgatcattctcctattggtcttctttgttggttcttctgtgagccaaccatgtcatcccaacgacttatctgcgctccgggaattggcaggagcgttgaagaacaagtctgttacagaatcttggttaaatggttcacgttgttgtgaatgggatggtgtgttttgtgaagggagtgatgtttctggtcgagttacaaagttggttttacctgaaaaaggtttggaaggtgtgatttcgaagtctttaggggagttgactgagctgcgagtacttgatctatctcgtaaccagcttaaaggcgaagtaccagcggagatttctaagttagagcagcttcaagttcttgatttgagtcataacctgttatcagggtctgttttgggagtggtttcgggtttaaagctgattcagtcgctgaacatttcgagcaattcgcttagcgggaagttatcggatgttggagtgtttcctggtcttgtgatgcttaatgtaagcaacaatttgtttgagggtgagattcatcctgaactctgtagctcatctggtgggatacaggttcttgatttatcgatgaatcgtttggtggggaatcttgatggcttgtacaactgcagcaaatctattcaacagctccatatcgacagcaacagattgacgggccaacttccggattatctttattcgatccgggagttggagcaactatcactctctggaaactacttatccggagagttaagcaagaacttgagcaatctctctggtctgaagtctctgttgatatcagagaaccggttttcggatgtaattccagatgtttttggtaacctcactcaattggaacacctcgacgtgagctccaacaagttctcgggaaggtttccgccaagtttatcccaatgctcgaagctgcgggttcttgatcttaggaacaactcgttatccggttctatcaatcttaacttcactggatttaccgatctttgcgtgcttgatctcgccagtaatcatttctctggacctcttcctgattcccttggccactgtcccaagatgaagatcttgagtttggcgaaaaacgagtttcgcggcaaaatccctgacaccttcaagaatctgcagtctctcttgttcctgtccttatccaacaacagctttgtggatttttctgagacaatgaatgtgctgcaacattgcagaaacctctccactcttattctctcaaagaacttcatcggcgaggaaataccaaacaacgtcactggtttcgacaacctcgcgattttagcgctaggaaattgcggtcttagaggtcagattccgagctggctattgaactgcaagaagctggaagttcttgatctctcttggaatcacttttacggaactatccctcattggattggtaagatggagagtttgttctacatagacttctcaaacaacactttgaccggagcaatcccggtagccataaccgagctcaagaacctaatccgtctaaacggaaccgcttctcagatgaccgactcttctggaattcctctctacgtaaagcggaacaagagctccaacggtcttccatataaccaagtttcaagattcccgccatctatctatttgaataataaccgtctcaacgggacgatcttgccagagataggacgtttgaaagagcttcacatgctggacttgagcaggaacaacttcactgggacgatacctgattccatttcagggcttgacaatttggaggttcttgatttatcttacaatcatctctacggttcgattcctctgtcttttcagagtctcactttcttgtcgaggttcagcgtagcgtataaccgtctcactggcgcgattccatctggaggtcagttctacagcttcccgcactcaagcttcgaaggaaacttaggactttgtcgcgcgattgattctccttgcgatgttctgatgagtaacatgttgaatccgaaaggttcttcgcgtaggaataacaatggcggaaagttcgggagaagcagcattgttgtacttaccataagtctagccattgggattactctacttctttctgttattctgttaaggatttcaagaaaagatgtggatgatcgaatcaatgacgttgatgaggagactatcagcggggtttcgaaagctctcgggccatcaaagattgtgcttttccatagctgtggatgtaaagatctaagtgttgaggagttgttgaagtctacgaacaatttcagccaggctaacattataggatgtggcggatttggtcttgtgtacaaagctaattttcccgatggctcgaaagcagcagtcaagaggctttctggtgactgtgggcagatggaacgtgaattccaagcggaagttgaagcattgtctcgagcggaacataagaatctagtctctcttcaaggctactgcaagcatggaaacgataggctgcttatttactcgtttatggagaatggaagtttggattattggctgcatgagcgggtagatgggaatatgactcttatatgggatgtgagattgaagatagctcaaggcgcagcgcgagggcttgcttacttgcataaagtctgtgaacctaatgttatacatagggatgtgaagtctagtaacattttgttagatgagaagtttgaagctcatcttgcggattttgggttagcgaggttgcttaggccgtatgatactcacgtgacgactgatttggttgggacattgggttatattcctcctgagtatagccagtctttgattgcaacatgtagaggagacgtttacagttttggcgttgtgcttttggagctagttacgggtcgtagacctgtagaagtctgtaaagggaaaagttgcagagatttggtgtctcgggtgtttcaaatgaaggctgagaagcgtgaagctgagcttatcgatacaacaatacgcgaaaatgtgaacgagagaacggttttggagatgttggagattgcttgcaaatgcattgatcatgagcctagaaggagaccactgatcgaagaagtcgttacttggcttgaagatcttcctatggagtctgttcaacaacaatga

SEQ ID NO: 46 - DNA, 1113 bp, Arabidopsis thaliana
atgggaagagcgccatgttgcgagaaggtcggtatcaagagagggcggtggacggcggaggaggaccagattctctccaactacattcaatccaacggtgaaggttcttggagatctctccccaaaaatgccggattaaaaaggtgtggaaagagctgtagattgagatggataaactatctaagatcagacctcaagcgtggaaacataactccagaagaagaagaactcgttgttaaattgcattccactttgggaaacaggtggtcactaatcgcgggtcatctaccagggagaacagacaacgaaataaaaaattattggaactctcatctcagccgtaaactccacaacttcattaggaagccatccatctctcaagacgtctccgccgtaatcatgacgaacgcttcttcagcgccaccgccgccgcaggcaaaacgcagacttgggagaacgagtaggtccgctatgaaaccaaaaatccacagaacaaaaactcgtaaaacgaagaaaacgtctgcaccaccggagcctaacgccgatgtagctggggctgataaagaagcattaatggtggagtcaagtggagccgaggctgagctaggacgaccatgtgactactatggagatgattgtaacaaaaatctcatgagcattaatggcgataatggagttttaacgtttgatgatgatatcatcgatcttttgttggacgagtcagatcctggccacttgtacacaaacacaacgtgcggtggtgatggggagttgcataacataagagactctgaaggagccagagggttctcggatacttggaaccaagggaatctcgactgtcttcttcagtcttgtccatcggtggagtcgtttctcaactacgaccaccaagttaacgatgcgtcgacggatgagtttatcgattgggattgtgtttggcaagaaggtagtgataataatctttggcatgagaaagagaatcccgactcaatggtctcgtggcttttagacggtgatgatgaggccacgatcgggaatagtaattgtgagaactttggagaaccgttagatcatgacgacgaaagcgctttggtcgcttggcttctgtca

SEQ ID NO: 47 - DNA, 921 bp, Arabidopsis thaliana
atgccaactttgtacaaaaaagcaggctcctgcaggaccatggggaagggaagagcaccttgttgtgacaagaccaaagtgaagagaggtccatggagcccagaagaagacattaaactcatctctttcattcaaaagtttggtcatgagaactggagatctctccccaaacaatctgggctattgaggtgtgggaagagttgtcgtctaaggtggattaactatcttaggccagatctgaagcgtggcaacttcacttcagaggaggaagaaacaatcattaagcttcaccacaactatgggaacaagtggtcgaaaatcgcttctcaacttccaggtagaacagataacgagatcaagaatgtgtggcacactcatctaaagaaaagactggctcagagctcaggaactgcagatgaaccggcctcgccttgttcgagtgattctgtttctcgtgggaaagatgataagtcatctcacgtagaagattctttgaacagagagactaatcataggaatgagttgtctacatctatgtcttctgggggttccaaccaacaagatgatccaaagatagacgaactcaggtttgagtatatagaagaagcttatagcgagtttaacgacattattattcaagaggtagacaaacccgatctgctggagataccatttgattcagatcctgacatttggagtttcttagatacttcaaactcatttcaacaatccactgcaaatgagaacagctcaggctcaagagcaacaacagaagaagagtctgatgaggatgaggttaagaaatggttcaagcacctagaaagcgaactcgggttagaagaagacgataatcaacaacaatacaaagaagaagaatcatcatcatcatcactcttgaagaactacgagctcatgatacat

SEQ ID NO: 48 - DNA, 708 bp, Arabidopsis thaliana
atgggaagatctccttgttgtgaaaaagctcacacaaacaaaggagcttggactaaagaagaagatcaacgtctcgtagattatatccgtaatcacggtgaaggttgttggcgttctcttcctaaatccgctggattgttgcgttgtggtaaaagttgtagattgagatggattaattaccttcgtcctgatcttaaacgtggtaattttactgatgatgaagatcaaatcatcatcaaactccatagcttactcggtaacaaatggtcattgatagctggaagattaccaggaagaacagataacgaaataaagaattattggaacactcatattaagaggaagcttcttagtcacggtattgatccacaaactcatcgtcagattaacgaatccaaaacggtgtcgtctcaagttgttgttcctattcaaaacgatgccgttgagtattctttttccaatttagccgttaaaccgaagacggaaaattcctccgataacggagcttcgactagcggcacgacgacggacgaggatctccggcagaatggggagtgttattatagtgataattcaggacatataaagctgaatttggatttaactcttgggtttggatcctggtcgggtcggatagtcggagtcgggtcatcggctgattctaaaccgtggtgcgacccggtgatggaggcgcgtttgtcactgttg

SEQ ID NO: 49 - DNA, 711 bp, Arabidopsis thaliana
atgggaagatctccttgttgtgaaaaagctcacacaaacaaaggagcttggactaaagaagaagatcaacgtctcgtagattatatccgtaatcacggtgaaggttgttggcgttctcttcctaaatccgctggattgttgcgttgtggtaaaagttgtagattgagatggattaattaccttcgtcctgatcttaaacgtggtaattttactgatgatgaagatcaaatcatcatcaaactccatagcttactcggtaacaaatggtcattgatagctggaagattaccaggaagaacagataacgaaataaagaattattggaacactcatattaagaggaagcttcttagtcacggtattgatccacaaactcatcgtcagattaacgaatccaaaacggtgtcgtctcaagttgttgttcctattcaaaacgatgccgttgagtattctttttccaatttagccgttaaaccgaagacggaaaattcctccgataacggagcttcgactagcggcacgacgacggacgaggatctccggcagaatggggagtgttattatagtgataattcaggacatataaagctgaatttggatttaactcttgggtttggatcctggtcgggtcggatagtcggagtcgggtcatcggctgattctaaaccgtggtgcgacccggtgatggaggcgcgtttgtcactgttgtaa

SEQ ID NO: 50 - DNA, 990 bp, Arabidopsis thaliana
atgggaagagctccgtgttgcgacaagacaaaagtgaagcgagggccttggtcgcctgaagaagactctaaacttagagattacattgaaaagtatggtaatggtggaaattggatctctttccccctcaaagccggtttgaggagatgtgggaagagttgtagactgaggtggctaaactatttgagaccaaacataaagcatggtgacttctctgaggaagaagacaggatcatttttagtctcttcgctgccataggaagcaggtggtcaataatagcagctcatctaccgggacgaacagacaacgacataaaaaactattggaacacaaagctaaggaagaaactcttgtcttcttcctctgattcatcatcatcagccatggcttctccttatctaaaccctatttctcaggatgtgaaaagaccaacctcaccaacaacaatcccatcttcttcttacaatccgtatgctgaaaaccctaatcaatacccaacaaaatccctcatctccagcatcaatggcttcgaagctggtgacaaacagataatttcctatattaaccctaattatcctcaagatctctatctctcggacagcaacaacaacacctcgaacgcaaatggtttcttgctcaaccacaatatgtgtgatcagtacaagaaccacaccagtttttcttcagacgtcaatgggataagatcagagattatgatgaagcaagaagagataatgatgatgatgatgatagaccaccacattgaccagaggacaaaagggtacaatggggaattcacacaagggtattataattactacaatgggcatggggatttgaagcaaatgattagtggaacaggcactaattctaacataaacatgggtggttcaggttcatcttctagttcgataagcaacctagctgagaacaaaagcagtggtagcctcctactagaatacaaatgcttgccctatttctactcctag

SEQ ID NO: 51 - DNA, 708 bp, Arabidopsis thaliana; identical to SEQ ID NO: 48

SEQ ID NO: 52 - DNA, 1299 bp, Arabidopsis thaliana
atgaggaggaggaggtgcgatcttcaaccgaagagaacgagaatgtgcgatcttcaaccgaagagaacgagtatgtgcgatcttccaccgaagctggtaggggagaagatcctcacgaggattccgataacatctctgagagcggtgcgatccacttgcaaattatggaacgctttaaccaaagatcgggttctgggtaaagcagcggcgcagtttttggggtttatgacgatggattcaaaggtctgttcagttagattccatctccgtcgcagcaaggaggaagaagaagacacgatggatctatctataaagcaggtagatttgcttaatcaagtcgagatatctagagtgtatcactgcgacggcttgttgttatgcgtggctaaggacaactcgagggtcgtggtttggaacccttatttggggcaaacaagatggatcagacccagaacagaatccaacataggagacagctatgctcttggatacgacatcaaccgtaaccacaaaatcttgaggatggtgcagacaagaaacgtttccgtttacaggtacgaaatctacgacttgcgctctaattcatggagggttctcgaggtcactcccaacggggaaatggaccctaatcatcccctctacggcgtttctgtgaagggaaatacctacttttttgcgcatgaggatagcagcagtggtgaaattgatgaagatggcgacataatcgatcttgaagatttcttactctgttttgattttacaacagagacatttggtctgcgtctgcctcttccgtttcactctactatcgatgcgactgtgaccctctcttgtgttagagaccagcagctcgcggtgctatatcataatgagggtcttcacagtgatgatcggtttaccacagttgagttttgggttactactagtattgagcccaactctgtgtcctggagcaagtttttgacagtggatatgagaccattggcactcactggtgttcggtttgacaatgatatgggtgccaccttcttcattgacgaggatgagaaagttgctgtggttttcgatctagacggatacctaagcaccgagagcgctcgttaccacaccgcttttatcagtggaaaggatggattctttaaacctgtgactctaggagtagctcccaatgtcggggaaccttgtcccagaaccgggcatattccgactacatatcgtcccccgcttgtctgctcgtctacttaccttccgagtttagtgcaagtcaaccaacagcgcaaaaggaaagaaagacatgtt

SEQ ID NO: 53 - DNA, 1173 bp, Arabidopsis thaliana
atggttcagatttccgatcttccacgggatttgacagaggaggtgctctctaggattccggtgacatctatgagagcagtgagatttacttgcaaaaagtggaacaccttatcgaaagatcggagctttacaaagaagcacctgcgtggagcaagagcagcagcaaagaagaagcagacgaaggagtttcaggtgatcatgatgattcaatttagggtttatttatacagcgtcaacctccttaatccatcaatagagcgtataggtaaacttattagcctagacgttgaagatcatgtcgacatatctaaaatctttcactgcggcggtttattgttatgtatcaccaaagacatatctaggcttgtggtttggaacccttattctgggcaaacaaggtggatcaaacctagaaattcttaccacagattggacaggtacgctttaggatacgaagagaagaacaagtcgtgtcgttgctacaaaatcttgagatttatggatgattacgaggatgacagggcactgcgcctaattcgtgagtttgaaatctacgacttaaactctgattcatggaaggttgttaatgtcactcccgactgggatgtagagttttatcaccgtggcctgtctctcaaggggaatacttactggtttgctcaagagaagcttccaccattaccacgcggaagagtgataacaatatcagatatggctgatttcttactctgttttgattttacaagggagagatttggaccgcgcctgcctctgcctttccactcttttgttgaagatactgtgactctatccagtgttagagataagaaacttgcagtgttatttcagccatgtagtgcatctaccgtgaagatatggattagtcgcaagattgagcccaatgcagtgtcgtggaggaaggttttcttagcggttgatatgaaatcactcactggttttcagtttgacattaacgctgcaagtttctttgttgacgagaagaaaaaggtcgccatggttctggataaagacaggttcagttataaatttactcgcaacatagcttacatcattgggaagaaggggtacttcgaaaaagtggatcttggagaatctacagtttcaagttgtgcctcacttgtgtgctcttacgttccaagctcagtgcaaatc

SEQ ID NO: 54 - DNA, 1005 bp, Arabidopsis thaliana
atgttggaaggtcttgtctctcaagaaagcttgtccttaaactctatggacatgtctgtacttgaaaggcttaaatgggtacaacagcaacaacagcaactgcaacaagttgtgtcccatagcagtaataattcacctgaacttcttcagatacttcagttccatggaagcaacaatgatgagttgttggagagtagtttcagccaatttcaaatgcttggatctggttttggaccaaactataacatgggttttggtcctccacatgaatccatttcaagaacaagtagctgccatatggaacctgtggatacaatggaggttttgttgaagaccggtgaagaaaccagagccgttgccttgaagaacaagagaaaaccagaggttaagacaagggaagagcaaaagacagagaagaagatcaaagtagaggctgagacagagtcaagcatgaaaggaaaatcaaacatgggaaacactgaagcatcttcagacacttcaaaggagacatcgaaaggagcttcagagaatcagaaattagattatatccacgtgagagctcgtcgaggccaagccactgacagacacagcttagcagaaagggcgagaagagaaaagatcagcaagaaaatgaaatatctgcaagatattgtgcctggatgcaataaggtcacaggaaaagctggtatgcttgatgagatcatcaattatgttcaatgtctccaaagacaagtcgagttcctgtcgatgaaacttgctgtcttgaacccggaactagagcttgccgtggaagatgtatccgtaaaacaggcttactttacaaatgtagttgcttcaaagcaatcaataatggttgatgtgccattgtttccgttagaccagcaaggatctctagatttgtctgcgataaacccgaaccaaacgacatctatcgaagctccatctggaagctgggaaactcaatcacagagtctctacaacacatctagcctcggttttcattac

SEQ ID NO: 55 - DNA, 1008 bp, Arabidopsis thaliana
atgttggaaggtcttgtctctcaagaaagcttgtccttaaactctatggacatgtctgtacttgaaaggcttaaatgggtacaacagcaacaacagcaactgcaacaagttgtgtcccatagcagtaataattcacctgaacttcttcagatacttcagttccatggaagcaacaatgatgagttgttggagagtagtttcagccaatttcaaatgcttggatctggttttggaccaaactataacatgggttttggtcctccacatgaatccatttcaagaacaagtagctgccatatggaacctgtggatacaatggaggttttgttgaagaccggtgaagaaaccagagccgttgccttgaagaacaagagaaaaccagaggttaagacaagggaagagcaaaagacagagaagaagatcaaagtagaggctgagacagagtcaagcatgaaaggaaaatcaaacatgggaaacactgaagcatcttcagacacttcaaaggagacatcgaaaggagcttcagagaatcagaaattagattatatccacgtgagagctcgtcgaggccaagccactgacagacacagcttagcagaaagggcgagaagagaaaagatcagcaagaaaatgaaatatctgcaagatattgtgcctggatgcaataaggtcacaggaaaagctggtatgcttgatgagatcatcaattatgttcaatgtctccaaagacaagtcgagttcctgtcgatgaaacttgctgtcttgaacccggaactagagcttgccgtggaagatgtatccgtaaaacaggcttactttacaaatgtagttgcttcaaagcaatcaataatggttgatgtgccattgtttccgttagaccagcaaggatctctagatttgtctgcgataaacccgaaccaaacgacatctatcgaagctccatctggaagctgggaaactcaatcacagagtctctacaacacatctagcctcggttttcattactaa

SEQ ID NO: 56 - DNA, 798 bp, Canola (Brassica napus or Brassica rapa)
  misc_feature (509)..(509): n is a, c, g, or t
  misc_feature (513)..(513): n is a, c, g, or t
  misc_feature (526)..(526): n is a, c, g, or t
  misc_feature (537)..(537): n is a, c, g, or t
  misc_feature (543)..(543): n is a, c, g, or t
  misc_feature (552)..(552): n is a, c, g, or t
  misc_feature (568)..(569): n is a, c, g, or t
  misc_feature (588)..(588): n is a, c, g, or t
  misc_feature (616)..(616): n is a, c, g, or t
  misc_feature (647)..(647): n is a, c, g, or t
  misc_feature (652)..(652): n is a, c, g, or t
  misc_feature (699)..(699): n is a, c, g, or t
  misc_feature (707)..(707): n is a, c, g, or t
  misc_feature (732)..(732): n is a, c, g, or t
  misc_feature (760)..(760): n is a, c, g, or t
  misc_feature (769)..(769): n is a, c, g, or t
  misc_feature (777)..(777): n is a, c, g, or t
gacttttggtgttttagagtgcattccacaaactctatgcctcgtgtaataaccctttgcattggttagatccattctacaaccttccacttgacaccttggtatctgacccgaaggacccgacccgcttccacgtacccttctgtttgacccgccggaggaagaagacccggttccacctccagcgtcctcgaagtagatcctctggccaaacatgagccctccacttaaagaggatgactcagtggatgaaccacccgactctgtctggcctggaccaagaccaagacccgagttggaacccctatccattttggtttcctcttactcagacagaaagggagtactcactcatcattctctctctctctctctctctctcttaaaacctaactgtctcggtttaaaggaaaggacgaaaggagaagaaagcaaagaaaattttggcttccctgattttgactgttgttgggtttagagaaagaagatagagagagacccaacagaancaanaaaagagacgagngtggtaatagncaaagncagtaaganagttaagtaaaacggnncggacaaaacataaactgntgtctgttaattaccacataacaaaaangagagatagagagtgatgtagtagcagtttntaatnttggagttggaagagacttgaacaaatgaacattggagaggtctttntttcatgnacacattttaattattttactttanactgttcacattttcaaccttttagtanatttttttntcctttcnattataaaaaaaaaaaaaaaa

SEQ ID NO: 57 - DNA, 1104 bp, Canola (Brassica napus or Brassica rapa)
gcggccgccctttttttttttttttagttcaaatgtgcttttgttagatgtgaacaaaacaaagagatcatcactaaaaacaaacggcttaaagatcaagagccaaaagcattaaagtaatacccaaaacaaaagtcattttctgccatcattgtctgatttttaagtagcatagatagaacagacaagtcttagtagcaatcttccatagataaggctcttggtgcagatgaacaagttaagaaaaagaagtctttaaagactcaaagagaccagttgaaatgctgaggggaagagtcataagctcttgtgttctcaggttccaggtattgcctaagaacctgctgatgaggactcaactcgaatccacccatcgtggcgccattgcttatctggaaatcaactggctcagagatttggctcagttccaaaacaggagttgtataatgcgcattgcttttttcccctgacataaactcccatgtttggttcaagtattgattctggattgaaacgggtggtgtctgagccattgttaccctatcagcagcaatagaagatggtcgccatgtattggttggtgtctgaagtggttgttgttcctgctggtttgggtttgtgtagtttgacagaagagagagagcacagctggagtctgtgctattagtaaagcttgagtttccatatgggaaaacattcatcagctgatggctttgccatggtgcagaacctcttgtggttgaccacctagtaggatctcccaaaacgcttctaatggcattcccatatagagatggagcgatgttggagtaatgaggagtcaagagagtggttgttgcttgaggctttcttcttcgttcgttgtggcaagcgagccgtcttctacaacttcgtttctctaagtcaaactccgaaagctggtgaaacctgctacattgctggcaaaacctttggtgaagaccagacacaatgactttagatgactttgagtgaatgcaacacactttgtgtcttgagtaataagttttagcattgcttagatccattctacaaccttccggacgcgtgggtcgacccggaatccggacggaactggaggcgtac

SEQ ID NO: 58 - DNA, 590 bp, Canola (Brassica napus or Brassica rapa)
  misc_feature (46)..(46): n is a, c, g, or t
  misc_feature (91)..(91): n is a, c, g, or t
  misc_feature (139)..(139): n is a, c, g, or t
  misc_feature (186)..(186): n is a, c, g, or t
  misc_feature (228)..(228): n is a, c, g, or t
  misc_feature (231)..(231): n is a, c, g, or t
  misc_feature (253)..(253): n is a, c, g, or t
  misc_feature (327)..(327): n is a, c, g, or t
  misc_feature (331)..(331): n is a, c, g, or t
  misc_feature (354)..(354): n is a, c, g, or t
  misc_feature (391)..(391): n is a, c, g, or t
  misc_feature (481)..(481): n is a, c, g, or t
  misc_feature (483)..(483): n is a, c, g, or t
ctgccgcatacgtctttctcatcataatgcaaggcgtcgcaagtcncaaggagtctttccatttaatccagagagggtgtatgatcaaagncagcatacaaatgttgtgtggggtaccacttgtgatacaaagccaacncagagggaaagtggctttaccttgagcttccagagaggcaatggatntaaggaagagcagttgtttgctagtagcaaccactctttatntgngtatcaaacctcaggcgggttntcagcagggaagaacaagtttcaacttggtgtgggagaatactcagaagtcctccatcaatttcaagatttccnccgngctttctctcttctgtcaacttnttctggtcccctggttcacccacatgcacagcaaccnctgtctctacttttttcatttgatggtgtaccaaaataggcgagtaagtgatttggaatttgtaaaaccagttagcttcagttagtgganantaatccaaacctatcagatcagctgcctccttttgtatgttgtatttatcattgttttgttactcattagtaagcaaagcaaactgtcaacaaaaaaaaaaaaaaaa

SEQ ID NO: 59 - DNA, 973 bp, Canola (Brassica napus or Brassica rapa)
accaagtccaattcctcaactttgctaaacttacaagagcttctctccaaaaatggatggtaagaaaacacaaggacaagggtatctgaaaaagaaggctagtgtgtcttaccttgtggaagaagaattggagaatgatacagatggagaggaggaagagaagaggaaaggtgtgaccgataggtttaaaggatctagcggcagcaatgatcgtggctcatcacggctttgccaagtagatagatgcacagctgatctgaaagaagctaaacagtatcaccggaggcacaaagtgtgtgaagttcatgcaaaggcatcttctgtctatctcacaggcgttaaacaacggttctgtcaacaatgcagcaggttccatgagctcctagagtttgatgaagctaaaaaaagttgccggaagcgcttagctggacacaacgagaggcggaggaagagctccggtgaaagtattggagaagggtcaggtggtcgaagaggaataacagctcagatgatccagaatcaagaaagatcaagggtagagatgacacttcctatgtcaaacacatcattcaagcgaccacagattaaatagagaagctgtctgctctctctcttctgtcattataaaattctcttagaatctgaaattgtggtatccatcaatgtcaaaaaagaaacagctgagtcatggtattgactcctcctggtatagataaataactaataaatacccctcttctatctatgtatcgttggggggttacctatccccaaatgctaagactttggcttaaccttgagtcgaaataagtctactgtgtcatgtatgttttcgaaaatgtatgatgtgttcccctaattggtaaaaggttttccataaaaaaaaaaaaaaaaaaaaaaaaaaaaaaaaaaaaaaaaaaaaaaaaaaaaaaaaaaaaaaaaaaaaaaaaaaaaaaaaaaaaagggcggccgc

SEQ ID NO: 60 - DNA, 738 bp, Canola (Brassica napus or Brassica rapa)
gaaatttgtggtccaacaacataggcaccttacttttgtttggggggggggcctctacttctcttcccatgtcttcttcttccatctttcatgtgtgagagagagagagagagagagtagattctaaagatgagtacgagaagaagtagagcggaagggaagaggagtttaagagaaatgagtgaggaagaggaagaagatgaagaagatgaggagacatttgaaggggaagaagatgaagatacttctgaagaagaggccgtggaaaagaagcagaaaggcaaagctaccacaagtagtagcagtggtacaggagcttgtcaagtggagagatgtactgcagatatgaacagagccaaacaataccataaacgacacagagtctgcgagtttcatgccaaagctcctcttgttcggatctctggtctttaccaacgtttctgccaacaatgtagcaggtttcacgagctaagtgagtttgatgacaccaagaggagttgcaggagacgcttagctggacacaatgagagaaggcgtagaaacacaactcaataaaaaaaagacatgtgaatggtctcatgaactttagcctttgcttgctctcttctgtcagtctctttgtaatctctctgttttctccatattgcttgtaatctctagctatctgctaaaacttaagacatcaataaatgcatctttcccaaaaaaaaaaaaaaaaaaaaaaaaaaaaaacatgtc

SEQ ID NO: 61 - DNA, 808 bp, Canola (Brassica napus or Brassica rapa)
gacttggagaaaagaagttgtagaagacgtctagcttgtcataacgaaagaagaagaaagccccaagcaacaacagcagctcttttggcttctggttactctagaatcgctccatctctttacggaagcgttttgggagatcctacaacgtggtcaaccgcaagatctgtgatgggacggtccgcaccgtgggatagccatcaactgatgaacgttttgtcacagggaagttcaaggtttagtataacatacccagagatggtgaacaataatagcacagactcaagctgtgctctctctcttctgtcaaactcaaacacaactcagcagcagcagcagacatcaaccaatgcttacttgatggacgcagaaagggttacaatggctaagtcaccgcctgtttcagtacacaatcagtactcgaaacaaacctgggagttcatgtcaggcgaaaagagcaattggccttgtgtgtcgtcccctgttttgggactgagacaaatctctgagccagatgatgacctccagttcctgatgagcaatggcaccacaatgggtggattcgagctgaacctacagcaggagcaggttctgaggcaatactcttctactcaaaattttacttggcctctttgagactttctaccaagagcccttaccagtagaaggttgctagttgctactaagacttgatagtctcaagatcttattaaattatatatttttctatgctacttaaaacccgacaatggccttgaatctggatattatttttaatggttttggctcttgattttaaaaaaaaaaa

SEQ ID NO: 62 - DNA, 529 bp, Canola (Brassica napus or Brassica rapa)
ggcaggttgcatgccgtctctgaatttgatgagaagaaacgaagctgccgtaaacgtcttacgcatcataacgcgaggcgtcgcaagctgccaggaatatttccattgaatccagagagggtttgcaatccaagacatcatacaaatatgttgtgggatgagatgtctctaaacacgaaatctgaagaaacgttagcatgggatacaacttatgatacaaagcctacacagatagaaagcggctttactttgagcttccagagaggccatggccgccctgatgagcaggtggttgctggtagcagccgctctttctctccgtatcaaacctctagcgggttccaacttcccagcaaaggtgtaggagaatactcaggaggcctcaatgaatcgcaagatttctacagtgctctctctcttctgtcaacgtctttcggattcacgtgggaccaaacacaatcccatggtcgagtcacagccaatacatggcactttccctactcattttatgtagatgcgtaaggaatgc

SEQ ID NO: 63 - DNA, 870 bp, Canola (Brassica napus or Brassica rapa)
  misc_feature (526)..(526): n is a, c, g, or t
  misc_feature (553)..(553): n is a, c, g, or t
  misc_feature (668)..(668): n is a, c, g, or t
  misc_feature (671)..(671): n is a, c, g, or t
  misc_feature (819)..(819): n is a, c, g, or t
  misc_feature (850)..(850): n is a, c, g, or t
aacgatggagaccgtctcgtcctcgtctgttaacgatggaaaccgtctcgtcctcggtcgtctatctagtggcgggacaatatggggaagaaaggaagagcttgtgtagtagtcttggtcggagtcctcgtatgcaatatcacgctctctctcttgcttgtgaggttctattcctcatgaagctgttttaaagcatccttcaatccacatccataccatggcgcagcttcggttcattaacctcttgccaaaaatccacctttcgttccaacactaattgctgttaagtgggcgagttcatggaggcgtgcagcgtttcttgtagattggcataatttcggatatacattgctggcattgtctttaggaagaaacaatgtctttgtatccttataccgctgagcaataaacatcgatcatcaagaagtttttgctttgaccttctaacgtcagaacatcacaagtgtaaagactatcgcatctttcttcttgaggctcttctccttgacgaaaccggtccatcctntagtgaagacaaagctctgactacttntccagtaacaaaggcatgagtaaccagaggaaatatgtggaaatgcttttttacctgattggagaaatttcagagtaaatgagagtaacagatttttcacttttattatttactntanaagtgacataccgtcataacctaagtgttttataccatggatgacgagaattaacttggataaagtgatatgtatcagtaatttagtatgtgtatccaggggcggatgtatggtacgaccaacggagtcacgtgccccctactaaatnttgattttctttaagcaattgtattaaagcnaaagaaaaaaaaaaaaaaaa

SEQ ID NO: 64 - DNA, 472 bp, Canola (Brassica napus or Brassica rapa)
aacgatggagaccgtctcgtcctcgtctgttaacgatggaaaccgtctcgtcctcggtcgtctatctagtggcgggacaatatggggaagaaaggaagagcttgtgtagtagtcttggtcggagtcctcgtatgcaatatcacgctctctctcttgcttgtgaggttctattcctcatgaagctgttttaaagcatccttcaatccacatccataccatggcgcagcttcggttcattaacctcttgccaaagtaccagcacctgacattttcttggttcaaaatccacctttcgttccaacactaattgctgttaagtgggcgagttcatggaggcgtgcagcgtttcttgtagattggcataatttcggatatacattgctggcattgtctttaggaagaaacaatgtctttgtatccttataccgctgagcaataaacatcgatcatcaagaagtttttgctttgacct

SEQ ID NO: 65 - DNA, 643 bp, Canola (Brassica napus or Brassica rapa)
gtcgaccacgcgtccggggaagataacatgtcgactacatttacgatggtcggcggtgaaggtcctaacagttaccaacaacattctaaacatcagggagcattgcttgaagcttcaaaggagaggatcaacgaagccatctccactaagctcgacattgatttcacttcaggtctcattagcgttgcagatttcggttgttccactggacctaacactttcgccgccgtacaaaccgtaatagatgccgtggaacacaagtatcaaaaagacattgagttccaagttttcttcaacgattcttcaaacaacgatttcaacactctcttcaggacacttcctcctgctagaaaatattttgcaactggagttccagggtctttctttggtcgtgttcttcctaagaacagtttccatgtgggagttgcttctttcgcactccatttcgtatccaagattcctaagggagttagagagcgccattctccagtgtggaacaaggacatacattgcaccggattctcaaaagaggtagcgaacttgtaccttgatcaatacaagatagacgtggggagtttattgaacgcgagagctcaagagctcgtcttcgggggattgctattggttctttggacattggcta

SEQ ID NO: 66 - DNA, 445 bp, Canola (Brassica napus or Brassica rapa)
aaacagttctcatcaaacgttaagtattaatcaagagaagaagagttagaagaagggatagatcatggcaactactccaaaatggatcatggtgggaggagaaggtcctgagagttacaaccagaactcctcgtatcagagagcactgttagaagcggcaaaagaaaagatgagcgaggctatcaaggccaaactcagccttgatttgatctatgatcgcttcagtgtggcagattttggttgtgcgagtggacctaacacttttgttgcagtccaaaacatcattgatgcagttgaagacaagtaccgcaaggaaaccggacaaaacccggccgagaacatcgagttccaagtcctcttcaacgactttaccactaacgatttcaacactctcttccagtcacttcctgcgggcagaagatactatagtgctggtgttcctggt

SEQ ID NO: 67 - DNA, 688 bp, Canola (Brassica napus or Brassica rapa)
ctaatcgaaaaacagttctcatcaaatatcaaggatcaaacaagaaaagatattggtcatggcaactactccacaatgggtcatgattggaggagaaggtcctgagagttacaaccaacactcttcgtatcagggagcattgttggaagccgcaaaagagaagatgaacgaggctatctcagccaaactcagcctcgacttgatttctggtcgcttcactgttgctgattttggttgtgcgagtggacctaacacttttgtggcagtacaaaacataatagatgcagtagaagacaagtatctcaaggcaaccggacaaaaccctgcggagaacatcgagttccaagtcctcttcaatgattctaccaccaacgatttcaacactctcttccaggcacttcctgcggggagacgctactatagcgctggtgttccgggttccttcttcggccgtgtcctccctaagcatagtttccacataggagtcatcagttatgctttccatttcacctccgaaaaccccaaagggatcaccgaccgtgactctcctctgtggaacagagacatgcattgcactggcttttacgaagcagtcaagaaagcatatcttgatcagtactcggccgacaccaagaatctattagacgctagagctgaggagatcgtccccgggggtttgatgttgctt

SEQ ID NO: 68 - DNA, 747 bp, Canola (Brassica napus or Brassica rapa)
  misc_feature (722)..(722): n is a, c, g, or t
  misc_feature (724)..(725): n is a, c, g, or t
  misc_feature (727)..(730): n is a, c, g, or t
  misc_feature (732)..(733): n is a, c, g, or t
  misc_feature (735)..(735): n is a, c, g, or t
  misc_feature (738)..(740): n is a, c, g, or t
accgctatacgtgagtcgtattgccgggtaccttacttcctccgttaaggatgaatgggttctctctaaagttagtctgaaaagcagcgtagttgtcggtagagagcagacgaagttgctctcttcttctaccgcttccgtcgccggagaagtctcctcttctgctccgatcattgacgcctttgcgacggagcacgtgtcctgtttctccaatacctccgctgcagctcatgccgatacgagctttcctacgtaccttcccgctccgccgctttcactgccacgtcagcctcgacgaataggtggtgatgacgtggcgtttggtcagtttatggatatgggatcttcagggcagtttaatgtcgacgaagcagcaacgttcttaccgtatctgcctccgacggttcttcatcctcctcagacgttcgaactgtacggtggctcggccctgagttgctggccgtttgctctctgatgatcgttgctatgctggtttagtctcgactctcgaaccatttgtttgttgtgttgtgttactcgcatgtacgtgtgtttgtaatatctctatgcgtgttgtaacatgacttgtatgtcatttcctagcagtagtagtactctcggatcatttgcattatgttttgtaatgtcttttgcatgactttttttatattaatttcttgtttgcttggtcattaaaattaatcacagttaacttaaaaaanannannnnannanaannntcctgtt

SEQ ID NO: 69 - DNA, 1242 bp, Canola (Brassica napus or Brassica rapa)
  misc_feature (2)..(3): n is a, c, g, or t
  misc_feature (19)..(20): n is a, c, g, or t
gnnggctcgacgggcctannttacgggccgggggaattcaagaaatcgactcaattcttttctccgatcaaaataagaaaaaatcatttgagaaacacatgtttacgattatttgatattttattccaggatcagatatttgcttttcttttgggggacaaaaaaaagatggaaactattggtgggtttcacaaggaagatgatgagcagatggatttgcctcctggttttaggtttcatccaacagacgaagaaattataacccactatctacacaagaaggttctcgacaaagatttctcggctaaagctattggcgaggtggacttgaacaaagctgaaccacgggagttgccgtataaagcaaaaacgggtgagaaagaatggtacttcttctgtgcgagggatagaaagtatccaaccggtctgaggactaaccgggcaactcaagccggttattggaaggcaaccgggaaggataaggagattttccgaggaaaatcgcttgttggtatgaagaaaacacttgttttctacaaaggaagagctccaaaaggcttgaaaacaaactgggtgatgcatgagtataggcttgatgggaaactctctgctcataacttgcccaataccgctaagaatgagtgggtgatatgtagggtgtttcagaagagtgctggagggaagaagatcccactttcggctctaatccgaatcggttcgtatggaggggactttagcccttcccttatgccttctttaaccgatgcttcacctttcaccgataaaaccaaaacagaaccggtttacgtgccctgcttctccaaccaaactgatcaagcccaaggaaacccacttaactgcttcagcagccctgacattttccacaggattccactctaccaaactcaatccctccaggtctctggtaatctacagagtcccattcttggtcaagaacattcggtcctgcatgctatgattgataacaacagaaggcagagtctcaaagggatgagtgtctcacaagaaaccgcagtttctactcacatgcacaccgatatttcgtcggattttgaatacggtaaaagacgtgctcaagaagatccgtcgtcctctgctggacctgttgatcttgaccctttctggaattactgaagaagattcaagagtctcgtgttcactaatttactgtcataaagaaagtaagaaaagttaccaaaaaaaaaaaaaaagggcggccgc

SEQ ID NO: 70 - DNA, 1192 bp, Canola (Brassica napus or Brassica rapa)
gtcgacccacgcgtccgcaaaacccttttattcatctcttcaaaaacccttctcttctctcttacataactttgattgtttctaataaactttattaggataaatggattacgatgcatcaagaatcggtgaaatagtagaagatgaagagcaaattgatctgccacctggattcagatttcaccctactgatgaagaactcataactcactatctcaaacaaaaggtcttcaacactttcttctctgccaccgccattggtgaagttgatctcaacaagatcgagccttgggagttaccaaggaaagctaagataggggagaaagaatggtatttcttttgtgtgcgagaccggaaatacccaaccggtttaaggacaaaccgggcaactgaagccggttactggaaagccacaggcaaagataaagagattttcaaggggaagtcacttgtgggtatgaagaagactctggttttctacaaaggaagagctcctaaaggagtaagaaccaattgggttatgcatgaatatcgattagaaggcatatattctatccaacatctctcccagacagctaagaacgattgggttatttgccgtgttttccataaacgtgccgatggtacaaaggttgatatgtcccatttaatgttgcttgattcacacgtaaaccggattgaaccggtcggattaccttcgttgatggattcttctcaacgagattccttccctggttcgtctactcacgtgacctgcttctccgaccaagaaaccgaagataaaagactcattcatctcgagtccaaagacggttctggtcctctgttttaccctgatcctctgtttctaacagacaatgattcgctaatgaaactgttgcttaacagtcacgaaacccagttccccggtactggtactgacccctccgctttagccggtatgggagaatcgggttgcttttggaatttctgaggtgtaatatctgttgtagacttgtaattcatgtgttcgtgtgagatatgaagattcttgttacattttttgtaaaaaataatgaagtcaatttattttgcaatgtagaattagcattttaatagatttgttagttaaataatataataaatacatttgtctaaaaaaaaaaaaaaaagggcggcggttttttttctgacagcaatctagtttataact

SEQ ID NO: 71 - DNA, 695 bp, Canola (Brassica napus or Brassica rapa)
cagctacttccgtcaacacactcccaatccttcacttccagctaaagacacaagctgtgaatctgttgtgacgagtggtcagcaccaagtagcatcactgaatcctccaagagatgctagtcctgcaggacttttgtccattgcagaagaaactttagcagagtttctttcaaaggcaactggaaccgctgttgagtgggttcagatgcctggaatgaagcctggtccggattccattggaatcattgctatttctcacggttgcgctggtgtggcagcacgcgcctgtggcctagttggtctcgagcctacaagggtcgcagagatcgtcaaggatcggccttcgtggttccgcgaatgccgagctgttgatgttatgaacgtgttgccaacagccaatggtggaaccattgagctgctttatatgcagctctatgcaccaactacgttggccccaccgcgcgacttctggctgctgcgttatacatctgttttagaagatggcagccttgtggtgtgcgagaggtctcttaagagcggtcctagtatgccaccggttcaacattttgttagagcagagatgcttcccagtgggtacttgatacggccttgtgatggtggtggttccatcatacacattgtggatcatatggatttagaggcttggagtgtgcctgaggtcttgcgccctctct

SEQ ID NO: 72 - DNA, 813 bp, Canola (Brassica napus or Brassica rapa)
  misc_feature (749)..(749): n is a, c, g, or t
gtcgaccacgcgtccgggagaccttggcggagttcctttgcaaggctacaggaactgctgtcgactgggttcagatgattgggatgaagcctggtccggattcgattggcatcgtcgctgtttcacgcaactgcagtggaatagcagcacgtgcctgtggcctcgtgagtttagaacccatgaaggttgctgaaatcctcaaagatcgtccatcttggttccgtgactgtcgaagtgttgagactctgagtgttatacccactggaaatggtggtactatcgagctcatcaacactcagatttatgctcccacaacactagcagcagctcgtgacttttggaccctgagatacagtactagtctagaagatggaagctatgtggtttgtgagaagtcactcactgctgcaactggtggccccaatggtccactttcttcgagctttgtgagagctaaaatgctttcaagcgggtttctcatccgtccttgtgacggtggtggttccatcatccacattgttgatcatgttgatttggatgtttcaagtgttcctgaagtcctgaggcctctctatgagtcttctaaaattctcgctcaaaaaatgacagttgctgctttgagacatgtgaggcaaattgctcaagagactagtggagaagttcagttcagtggtggacgccagcctgcagtcttaagaacttttagccaaagactctgccgggggtttcaatgatgctgtgaatggttntgcggatgatggatggtctccaatgagtagtgatggaggagaggatattactataatgatcaac

SEQ ID NO: 73 - DNA, 653 bp, Canola (Brassica napus or Brassica rapa)
cccctacagttgagtcgtattagcccggcataggacccctttttctgagaaccaacatccataatacctttgtgaaggtgtacaagtcagggtcttttggacgatcactagatataacgaagtttagcagctaccacgagctgcgaagcgagcttgctcgcatgtttggcctagaaggccagttagaagaccctgtgagatcaggctggcagcttgtatttgtcgaccgagagaacgatgttcttctcctcggcgatgacccttggccggagtttgtgagcagtgtgtggtgcataaagatactgtcaccacaagaagtgcagcagatggggaaaagaggccttgagcttctcaactcagctcctccatcctcgaacaacaacgtcgtcgagaagctcccgagcaataacgggaactgcgatgactttgggaaccggtcagacccgaggaaccttggtaacggtattgcatccgttgggggttcgttcaactactagagaagaaaaacccttttcttggtaatcaagttattatgtttatcaaaaatagtatttcatcttcttagttttaattactagtaagctaaactgtctttattacttacaaaagggagctttgcgttggcctttgtggagacaaaaaaaacaactaaa

SEQ ID NO: 74 - DNA, 506 bp, Canola (Brassica napus or Brassica rapa)
  misc_feature (502)..(503): n is a, c, g, or t
  misc_feature (505)..(505): n is a, c, g, or t
cccacgcgtccgcggacgcgtgggataatgagctgagagaagagttgggtaaaatgtttgacatcaaagggttgttggaagacgcctttagatcaggctggcagcttgtattcgtggacaaggaggatgacattcttcttctcggcgatgatccttgggagtcatttgtgaatagcgtttggtacataaagatactgtcgccagatgatgtgcacaaaatgggtgaacatggggaaggatcctccttcccacagaacctcacccatttctgattgatctatctcatttgggggcatcatcacaatgtttcccttgcttttatctgtttgaatgtgtctgtatgaacgtatcatttcgcaagttgggtcttagaaacttaaaaagacacttggtctggacgcactgtcttaaaaacatatgtttctttggtagcaacattaactcgtcttgctgtaataattagactcttctgttactgtaatgcccctgtgctactctttannana

SEQ ID NO: 75 - DNA, 1353 bp, Canola (Brassica napus or Brassica rapa)
  misc_feature (635)..(635): n is a, c, g, or t
  misc_feature (660)..(660): n is a, c, g, or t
  misc_feature (667)..(667): n is a, c, g, or t
  misc_feature (697)..(697): n is a, c, g, or t
  misc_feature (712)..(712): n is a, c, g, or t
  misc_feature (717)..(717): n is a, c, g, or t
  misc_feature (721)..(721): n is a, c, g, or t
  misc_feature (730)..(730): n is a, c, g, or t
gtacgacgatcaaaacaaaaataaaatactttaattcaactcaattccacaaaaattatatatttttttctttcttcctctcctcctcagatcgttcctcttcatctccttcaatcactcttaagactcttccgagacggtgtgttcgctctttgattgaatggaaagtgaagacatgcattcgaaacctgacggtgggaatcagatcgtttcagaggcggttcatcatcactccataaatagtttaaacccttggcaacgtgctgctgctgctgcctgcaacgcaagttctttagtggaggaagctggagataagtctatagcgttggagagccaagacaattgggaatcaacgaacgggtccaagtcaccatctagtagagatgaaaatggtaacaaggaatcaccacaagtcacatcctctccccaagaatcagctggagattacagtgaaaaaagtcaagaacttgtgcatgttggcgtcacaggacctcctcaccctcaacttgttagccacacagttggatgggcatcctcaaatccataccaggatccttattatgctggaatgatgggagcctatcccatggcttatgttccatatggtgggatgcctcattcaagaatgccactgnctcctgaggtggcacaggaaacagntttatgntaatgctaaacagtaccaggccattctgangcgtaggcaagcacncgccnaggnagagcttgnaatgagctaatcaaatccagaaagccttatctccatgaatctcggcatcagcatgctatggaggaggcctaggggcacctggaggacggtttgcaaagaaaactaacaccgaagcttcacagccaaaacctggagaaaagaacaatgctactcagtccccgacgtcatctcactctgaccaacctgaagcctggaatgatgagtgtagaaaacagtctgaagagatgcaaagctcagcttctaagagaagggaagaagcagaagaccgttcagggcaacaatggaacagcatttcctcaaaccatacttctcaagctcgtctagccatcaaatgacatctccactggcaactcattcttggctttctctttgttggcttatttggtagcagccattgaagagtcctctgtacaaatacttctgtgtttttcttcttttgggatatgtcaaatgttactgctttcttttgtcaactctctttagcacatttttgaatccaaaactatgtgtttaaaactaaattccaaagtgtgcaaactgaaaaaaagagtaattgaatacccacaaaatctttcaagactttcttggaaaaaaaaaaaaaaaaaaaaaaaaaaaaacatgtc

SEQ ID NO: 76 - DNA, 1250 bp, Canola (Brassica napus or Brassica rapa)
gaaaacttgctcagatcgttcatcttccaagcggaagcgtctccttccatcaccgtagacgccttccgtgacggtctctactcgctctttccctgaatggaaactgaagacatgcattcaaaatctgaaagtgggaatcagatcgtttcagaggctcatcatcatacatcatcaacgtccattaacagtttaaacccttggctgcgtgctgctgcttcctgcaatgcaaactcttctgtggaagaagctggagataagtcgatagcattggagaaccaaaccaatttggaatcatcaaacgggtccaagtcaccatctaaccgagatgaaaatggtaacaaggagtcacaagtcacagcctctccccaacagtcagctgcggattacagtgaaaaaagccaagaacttgtgcatcctggcagtacaccacctcctcaccctcaacttgttagccacactgttggatgggcatcctcaaatccataccaggattcatattatgctggaatgatgggagcctatcccttgacttatgttccacacggtgggatgcctcattcaagaatgcaactgcctcctgagatggcacaagaacctgtttacgtgaatgctaaacagtaccaggcgattatgaggcgaaggcaggcacgcgccaaggctgagctagagaagaagcttatcaaatccagaaagcgttatctacatgaatctcggcatcagcatgctatgaggaggcctaggggtactggaggacggtttgcaaagaaaactaacaccgaagcttcacagcaaaaagatggagaaaagagaaatgcttgtgctactcagtccccgacgtcatctcattctgatcagcatgaaggttgtagtgatgagtatagaacaaatcagtccgatgagatgcagagttcagcttataagataagggaagaagcagactgttcagggcagcagtggaacaacatttcctcaaaccatccttctcaacctcttttagctatcaagtaacctctacgctggcaaatcattcttggctctatctttgttggcttatgtgttagcagccattgaagagttatctcagttttcttctttcttgttttgtacaaacactagtgtgcttatgttagaatgcttctttgtcaacaccctttaggtttaataacaaacttgaagttttgaatccgaaactatgtgattgagaactaaaaaaaaaaaaaaaaaaatgaagaaaaaagagagtaatggag

SEQ ID NO: 77 - DNA, 736 bp, Canola (Brassica napus or Brassica rapa)
gataaaaattgcttttttttttcttcttcctctgactgaaaccaactcagatcgttcctcttcgcctccgggacggtctattcgctcttttgattgaatggaaactgaagacatgcaattcaaaatctgacagtaggagtcagaacactagtgcaagttcttttgtggaagaagctggagacagaccaccaccatctagtagagatggaaatggtaacaaagagacacaagtcacaacctctccccaatcagctggtgattacagtgaaaaaagtcaagaacttgtggatccttgcattacaacacctcaacttgttagccacacagttgtataatctttgatctagctgataaaatttcaataattttatgacaacacaagaaccagtttacgtgaatgctaaacagtaccaggcgattctgaggcgaaggcaggctcgtgccaaggcagagttagagaagagaaatgcttgtcgtactcagtccccaacatcatctagctctgatcagcctgaagcttggaatgataagaatagaacacaatccaaggagatgcagagcacagcttgtaagagaagggaagaagcagactgctcaggtcagcaatggaacatcatttccttaaatcatccttctcaagctcgtctagcaatcaagtgacgttgtctagaggcaactcattcttggcttttctctttgttggctttttttgctacttgtgctcttttctttttgc

SEQ ID NO: 78 - DNA, 1093 bp, Canola (Brassica napus or Brassica rapa)
ggaggtttagtcttttaagccatagccaatactacacttatttgcagagacagagagagagagggagacagaagaaacagccatgttttgaggaaggagacatgcatcatcatcatcatctcaagcttattacttaacttctatttctctccatcttttgccacatccaaacaccctcttttgcttgaatcagtgacagacaatgcaagtcccaacaaattcaaacattcaaggatctcaatcctttagcttaacaaagaacctgatgatgccctgcaagatgaagcattcgggtttacagctgcaagatcaagattcatcctcaacacaatctactgaagaatcaggcggtggttacatagtaagcccacagggaaaggctattgcaagttataccaaatcaacaaccacctcgtccatggtgtctcacgattctgtgtttcctcctacttatttcaatggcttcttggctcctgaatatgcatcccaatcaacggtgctgcctcatgtagagatgatgggtttggttacttcaagagtgccattgcctcataactatcaagagaatgaaccaatgttcgtcaatgccaaacagtaccatgccattcttcgtcgcaggaagcatcgtgctaagcttgaagctcagaacaaactcatcaaaagccgtaaaccgtaccttcatgagtctcgccatcttcatgctttaaagagagcaagaggctccggtgggcgtttcctcaatacaaagaagcttcaagaatcatcatcaaactccctctgttctagttcggccacacccagctccagttcagaccgtgacaacatgttccagaacccaccgttcagattctcagggtatccatcaacacaccatgtctcagctctcatgtcagggacgtgagagtcataatcttgctccagttgaaaaggggaagtcatacttggctataaaagtgttatttgcttctttacaaagtttctgccttttaaaaattatgttgtttttctatcatctcatcatctgcaacttcactcaactctacattgaagtaactttcatattcaaaaaaaaaaaaaaaaaaaaaaaaaaaaa

SEQ ID NO: 79 - DNA, 933 bp, Canola (Brassica napus or Brassica rapa)
  misc_feature (50)..(50): n is a, c, g, or t
ctcccgtcgtcttcctcgtctttacctccggttccgccgccgggaacggncgggcgatgaccaaacggtcatcatcgagcagctgttcaacgcggcggagcttatcgggaacaataacaacaacggcgaccacaccgctctcgcgcaagggatattggcgcggctcaatcaccatcctcagctacaacaacaataacaataacaagaaccctccgtttcaaagagcggcttctcacataaccgaatctctctcactcatcaacagctcatacccaccgttaatctcaccagagaatctgatccttcgaatcgctgcgtacagaacattctccgaaacgtcgccgtttcttcaattcgtcaacttcacagcgaaccagtcgattctcgagtcatgcaacgacgagctggggtttgatcggatccacattatcgacttcgacgttggatacggaggacaatggtcgtcgttgatgcaagagcttgcttcaaggagaagaaacagagcatcgtctttgaaaataacggtttttgctcctcctccgtcgacggtttccgacgagttcgagctcagattcacggaggagaacctcagaagcttcgccggggaagtcaagattccgtttgagatcgagctgttgagcctcgagcttcttctgaacccagcttattggcctgtctctctccgttcgtcggagaaagaagctgtcgcggtgaatcttcccgttaactccgtcgtgtccggttaccttccgttaatactccgttttctcaaacagatctctccaaacgtcgtcgtttgttcggacagaggatgtgaccgtaacgacgcgccgtttcctaacgctgtgatccacgcgcttcagtaccacaccactctgcttgagtctcttgatgctaatcaagggcacgaggatgagagtgttgagaggtttt

SEQ ID NO: 80 - DNA, 738 bp, Canola (Brassica napus or Brassica rapa)
  misc_feature (174)..(174): n is a, c, g, or t
  misc_feature (681)..(681): n is a, c, g, or t
gcggccgccctggttttttttttttatccaattcccatatatccaagcattatgtgaacttatgtaatacatattaccagatcgaggaaaaattaattcgatttaagttcctgagaaattttcttagcctaatataacaagacgttgaaagagaaatgaacaaacgaaaagccngtaattaatttaatgaccaagaacatatgagactttaaaggtacattttaccctgaaattgtttcttgtaagttaaagattcaaggtctcatgagaggaggttggaagccattggtctgcagccaattctgatgagaagtaggagtagaattaaaaatctgattgtgattatgaggagagaatcctgatgatgctgcagcatttgccaacacttggttcgcggtggtccgaccttcaaactggtggttctcggtcaccggaaacagcgagaatcctcctccgcggtgaatgttactgctgcccggaaattggtgaacagaattggggatatagttaaccattccggtttgacctaatccgagaatctcattagagtggagggaatcttgttggttcatcttgagccgcatatcttgacccttatgcttcgaattaaccgagtttcccaaactcaaatcgaggttatgatcctgttgaataggattccctgatgactcggcattcagntcttcgtcgtatatgcttgaataaagttagtcacagcatctttgccattacatttga

SEQ ID NO: 81 - DNA, 465 bp, Canola (Brassica napus or Brassica rapa)
cgacaccgaggttgaagctgctagagcttacgataaagctgcaatcaaatgtaatggcaaagacgctgtgactaactttgatccaagcatatacgacgacgaattgaatgccgagtcatcagggaatcctattcaacaagatcataacctcgatttgagtttgggaaactcggttaattcgaagcaaaagggtcaagatatgcggctcaagatgaaccaacaagattctcttcatcctaatgagattcttggattgggtcaaaccggaatggttaaccatatcccaaattcaaatctccaatttcggggcagcagcaacattggtggcggaggaggattctcactatttccggtggctgagaaccaccggtttgatggtcggaccacgacgaaccaagtgttggcaaatgctgcagcatcatcaggattctctcctcatcatcacaatcagatttttaattccac

SEQ ID NO: 82 - DNA, 407 bp, Canola (Brassica napus or Brassica rapa)
  misc_feature (1)..(1): n is a, c, g, or t
  misc_feature (370)..(370): n is a, c, g, or t
  misc_feature (376)..(376): n is a, c, g, or t
nttagatgaaggtttggtgctattgttcgtgaatgcaaagggctaaggcgattgtcaatatcgggtcttctcaccgacaaggttttcatgtatattggtaaattcgcgaaacaacttgagatgctttcaatagcatttgctggagatagtgatgcgggaatgatgcatgttatggaaggatgcaataatctgaggaagctggagattagagatagcccatttggtgatgctgcactcctggagaatgttaccaagtatgatacaatgcgatccctttggatgtcatcatgcaatgtcacagaaaagggatgccaaatccttgcatcaaagatgccaatgcttaatgtggaggttataaatgaggtagatnagagcnatgaaatggatgagaaccatggaatccccaa

SEQ ID NO: 83 - DNA, 679 bp, Canola (Brassica napus or Brassica rapa)
gatttggagccatagtagagcactgcaaagatctccggcggctctccctatcggggctgttgaccgacaaggttttcgaatacattgggacatatgcaaagaagatggagatgctgtcagtggcgtttgcaggagagagtgacttgggaatgcatcatgtgttgtcagggtgcgatagtttgaggaagcttgagataagggactgcccgtttggagacaaggcgctattggccaatgcttcgaagctggagacaatgcgatctctttggatgtcttcttgttcggtgagttttggagcctgcaagttattaggacagaagatgccaaagctcaatgtggaagtcattgatgaaagaggtccgccggactcgagaccagagagctgccctgttgagagagtgtttatataccgaacagtggcgggtcctcggtttgacatgcctggcttcgtgtggaacatggaccagcaacactcaaccatgagggtttgccaggcaaatggtcactactaaaaaataaacgaggaacacgagagagagagagagagagagagctccattaatttaatcctgagctgcttcatatgactaccaagctaatgagcaaagaatgagtgaagagagagggaggacatagagagaaagagatccgagagacctttgttgtatgtttgtttgtc

SEQ ID NO: 84 - DNA, 541 bp, Canola (Brassica napus or Brassica rapa)
ccctctcgtgcggtgcgatagcctgaggaaactagagataagggactgcccgtttggagacaaggcgctattggccagtgcttcgaagctggagacaatgcgatctctttggatgtcttcttgttccgtgagttttggagcctgtaagttattattacataagatgccaaagctcaatgtggaagtcatcgatgagcggggtccacctgactcgagacctgagagctgccctgttgagagagtggtttatataccgaacagtagcgggtcctcggtttgacatgcctgacttcgtctggaacatggaccaacagtcatcaatgagtgtttaacgaaaaactaaacgagctacattctttcattaaatccttgctcatcatctccccatataaatcgttccagtttaggaacatgggagagaaagaggggttggccttcattagtttatttctggggctgcttcatataacaacctagctcatgagcaacgagtaagaggaaaagagaggatccgagaggttccaagagacctttatatata

SEQ ID NO: 85 - DNA, 470 bp, Canola (Brassica napus or Brassica rapa)
agccggtggctatccaaagcacgctttacttcatgttaacggagcccgaagggatattgtcctacgacatggtctcagggcagtggaagcagtacatcataccgggtccaccggacctgagcgatcacacgctagcggagtgcggggagaggttgttgctggtgggtcttctgacgaaaaacgctgccacgtgcgtgtgcatatgggagctgcagaagatgacgctgctgtggaaggaggttgacagaatgccaaacatatggtgcttggagttttacggaaaggcacgtgaggatgaattgtctaggcaacaaagggtgtctgatgatgttgtccttgaggtcccagacagatgaaccgtctgattacctacaatgctgttactagggaatgggccaaggtccctggttgtaccgttcctcgtgggagaaaaaggcttttggatcgcttgcggaacggcgtttcattcc

SEQ ID NO: 86 - DNA, 575 bp, Canola (Brassica napus or Brassica rapa)
gacttcaaaacagaatcaaatatccactttctctctctctccctccactagagaaaagcttgaaccaaagcaaattcatattttgattctccttcaatggcttccatgtccaccgccttccccaaaacaactcctttcctctctcatcctctcaccaaatccgattccctgatcgcaaccaccgtttcatttccctccagcgcgagatctcgcagcctccgaagagccaccctccgcgtacgatccgcgctgatcgagccagacggcgggaagctggtggagcttgtggtcccggagacgcgacgaagggagaagaagcacgaggcggcggatttgccgagagtgaaactgacggcgatcgatttgcagtggatgcacgtgttgagcgaaggctgggcaagtccgcttagagggtttatgcgggaagctgagttccttcaaactcttcatttcaattcgcttcgtctcgacgacggatccggcgtcaatatgtctgtacctatcgttctcgccatcgatgatgaaaagaaagctctaatcggagaatctaaacgtgtcgcgcttgtttgattccg

SEQ ID NO: 87 - DNA, 458 bp, Canola (Brassica napus or Brassica rapa)
ttaattattacaagatttttgattaatcaatgtgcttgtaagagacacaacaacaagacaacttcctcaatggcttcttcagccgccatcgtcttctccggttctccttttcgatcatcaccaatcaataaccatcgtgtttccctctacgcctctagacccgtctctctccgtcgacgcggagctttttcccaccgcggtctcgccgtgaaagcggctctgatcgagccggacggagggaagctcatggacctcgtcgtcgaggaatcgaagcggcgcgtgatgaaacgcaaggcggagacggttcccgtaaggatcatgctgaatcgcgtggatctcgagtgggtacacgtgctcagcgaaggctgggcgagcccgctccgaggcttcatgagacagtcagagttcctccaaacacttcatttcaactcgatccggctcgaagacggctccgtcgt

SEQ ID NO: 88 - DNA, 499 bp, Canola (Brassica napus or Brassica rapa)
caattgaatttggtaacaaacattttctctcaaatctcaactcggaagcctgagagagagagagaaccttcgatggcttccatgtctgccgtcctcagcaaatcccctttcctctctcagcctctctccaaatctccatcctccgatctccccttctccgccgcaaccgtctctttcccctcgaaatcgcaccgtcgcggcggagtaatccgcgccggactcatctcccccgacggcgggaagctcgtggagctcgtggtggcggagccgcgacggcgggagaagaagcacgaggcggcggagctgccccgcgtggagctcacgtcgatcgacgtgcagtggatgcacgtgctgagcgaaggctgggcaagtccgctcggaggcttcatgagagaatccgagttcctccaaactcttcatttcaactcgcttcgtcttgacgacggatccgtcgtcaacatgtccgtgcctatcgtgctcgctattgacgacgagcaga

SEQ ID NO: 89 - DNA, 445 bp, Canola (Brassica napus or Brassica rapa)
ccaaccattccccccctccatctgctttctcgcgggcaaataaaaacgtgtagaacgacggtgtagtaggcagatctactccttgtgccgctacgctagcccgctaccgaagatcgggcccgtttcaaccggttcgttggtctgagcggagctaagatggggcgcatttcattttttggtcctttcgtctgattggagaagtgcccattccggtatcgctccccggcctccaaatacgcaccgacacagaacgtgttcgtacgcacgtacacatgttgggtacgggccctacttcggcaagaaggtggacccggagccaggaaggtgccggcgtacggacggcaagaagtggcggtgctccaaggaggccgccccggactccaagtactgcgagcgccacatgcaccgcggccgcaaccgttcaagaaagcctgtggaagcgcag

SEQ ID NO: 90 - DNA, 745 bp, Canola (Brassica napus or Brassica rapa)
gacactctctctcttccctatgcatttaaacggtgaagaacagagcaaagagactttattctcttgttaaagtttttttttctttttgggaggtgggttttgtttcttaaggtctctagtttcaaaagctgtctcctttttctcgaatggaagaagagaaacacagtttacagagtaacaagatgcagagccctaaaacagaggagggggatgagtggaggaggaagaagtggccgtgtatgaaagctgctcagttacaagagtttagaatgcaagctttggtttatagatacatagaagctggtgttcgcgtgccgaatcatcttgtggtgcctatttggaatagtcttgctctctcttcttcttcttcctccagttaccttatccaccacaactatccctcctcttccaatgcagtgttgaatgataaggtggatcctgaacccacaaggtgcaggagaacagatgggaagaaatggcggtgtagcaacaaagtcctcctgtttcagaagtactgtgaacggcacatgcatagaggccgtaagcgttcaagaaagcttgtggaatcttcttcttcttatgacgttgcttcgtcgtctgcttcaaccaaacgagacaacactgatggtctgaacagtagtactgagagtcggagtgtttctcatggggcaatgtcagtttctagtaatgctcaggttgtcaccatggcttcactgcctagtgcaagagtctgtgatacatccct

SEQ ID NO: 91 - DNA, 879 bp, Canola (Brassica napus or Brassica rapa)
gactaaaaaaacgttcgaatcggtgaagaggtttggctaatcgctcgaggtttgacctgagatcacaacagaatcaatctctactcgaaacccttccgagtcaccatcacgatgtggagaagaatcgtctcttccggtctcaaaaccctagccgccgatgtcgccgtcgcttctccttctcgtcgatcgattcccgccgccgcgagacccgtcggcttccacctctctgccgatcgatcatccgtttctgctcccgcctccttcatcactcgccatttcagctcggaaccagtagtagggacctctgcgactaagaaggtggaggatgtgatgcccattgctactggtcatgagaaggaagagcttgaagctgaacttgaggggaggaggttgcttgacattgacttccccgaaggtccttttggaacaaaggaagctcctgctattgtaaaatcctactatgacaagcggattgtgggttgccctggtggggaaggagaggaggagcacgatgttgtgtggttttggctggagaaaggaaagtcttttgagtgtccggtctgcactcagtactttgagctggaagtggttggtcctggtggacctcccgatggtcacggtgatgaagacgatgagcaccatcactgagagactaacgttttgttttcagggttttcaaaagttctacttctacatttctttgttggaataaacaaatggttttcgatccttttgaaacacaccccaggcatcggagttctaaatgccccaactcttatgaccgtggtttcccccttttttgtaacactcttgaatctgaatcggtcttgcctcttgagcagaatgttcaaaaaaaaaaaaaaaaaaaaaaaaaaaaaa

SEQ ID NO: 92 - DNA, 585 bp, Canola (Brassica napus or Brassica rapa)
tactcgtgcatgcgctttgccagaaaggccttatgggtaacacaaagcttcttgaagagattttagatagtagccaagcgaatgcgcccttggatatagtcacttgcaccattctgatggatagttgttttaagagtggggatgtggttcaagcccttggggtttggaaggagatgtcggagaagaacgtccgtgctgattcggttgtgtacaatgtccttatccgtggcttatgttcgagtggttacatggtagatgcttatgggatcatgtgtgacatggtgaagaaaggagttagtcctgatgtttttacttacaatactctcataagcgccttgtgcaaggagggaaagtttgatgaggcatgtggtatccatggcaccatgaaacgagctggtgttgctcctgatcagatctcatacaaagtcatcattcaaggtctatgtatccacggagatgtggctagggcgaacgagtttcttttgaccatgctaaagagctctctgcttccggaggttctgctatggaacgtggtgattgatggctatggaagatgtggggatactagcagcgctttatctgttc

SEQ ID NO: 93 - DNA, 752 bp, Canola (Brassica napus or Brassica rapa)
aattaagtcacatcagttttcaattaaagatactgttacactcatacaaaaagatggcaaacttgagtacactcgttggttgcattgccatcatcttcttcactgtcgttgcacctgcctcctcagccactcattctgtcgaatggtcgcttgggaaggactatagctccttggctactggaaaaccttatgccattggcgatacaatcgtgttcaactacggtgcgggtcacacggtggacgaagtgagtgaaagtgactacaaaagttgcacattggggaactcaatttcttccgacagtagcggaaccacaagcatagctctcaagacagctggttctcactacttcatttgcgctatccccggccactgtgccggcggcatgaagctctctgtcaacgtaggtgcagcagcctcttcagacggtggcggtgacactggtgacggtaccaccgccaaaactacaccttctccgacgttagaaggcggaaaggctgctcctactgcttctgccactcctgtgttgaagccgttccaggctttggttgtgacttgtgtagttgcgttattatatgcttcggctctttcttagttgcctttaagtgtattggtgtggtttgactcgtctgaaagtcaggctagaggcagtgctattagccctatttttattgttacatgcttcttgttgtgatttagttattctatggtattaattacatgtgctaaaaaaaaaaaaaaaaagggcggccgc

SEQ ID NO: 94 - DNA, 662 bp, Canola (Brassica napus or Brassica rapa)
aaggaatcattcgattactacttttgaacgacaccgttttggattgcctagacctctctctctctcccatggccaccgtcgggcttcttcggtctctccgccgccgagaagtctacgtagtttctgtctcttcggcgtatagattcagttatgctagcgccggcgggaggacgacggagctccggttacccggagtcaaagatataaacgccgttgcgtctggtaaaggcggagtaggaaagtcttcgactgctgtgaacttagctgttgcattggccaacaaatgtgaactgaagatcggattgcttgatgcggatgtgtatggaccttctgttcctatcatgatgaacatcaatcaaaagcctcaagtcaaccaagatatgaaaatggttccagtggagaactatggagttaaatgcatgtccatgggactccttgttgataatgatgcaccacttgtgtggagaggtcctatggtaatgagtgctcttgctaagatgactagaggagttgattggggagatctcgatcttcttgttgttgatatgcctcctggaaccggtgatgctcagattaccatcttccaaaatcttaaactctcaggggctgtaattgtatcaactccacacgatgttgcgctcgctgatgctaatccagggatc

SEQ ID NO: 95 - DNA, 749 bp, Canola (Brassica napus or Brassica rapa)
  misc_feature (608)..(608): n is a, c, g, or t
agcgactgcaaaagttgacttgctctttcgttgcaactcatatctcttcttccaaagaacggtcgctgaaaggtgaatcagatagaaccgagttgcagatctgtttcataaaaggaaatcagtgatggctgatgaaggtgtgtcagcgatggttgagggagttgtgtcctttggaatggagaaactctgggacctcctgagtcgagaatctgagcgattgcagggagtgcacgagcatgttgatgatctaaaacgccagatgagaaagttacagtcattgttgaaagatgcagatgccaggaaacataaaaatgaagctagtgagaagcttcttggaagatgtcaaagacattgttttcgatgcagaagatataatcgaatcctttcttttgaaagaatttagtggaaaccaaaaagggatcaagaggcgtgtgaaaagactttcttgtttcttagtggaccgcctatgtctttctagggacattgaaggcataactaagagaatagtcaaggttgttggacaaatgcagagctttggaatacagcatagcgtcaacaaaccaccgcctctacaaaagagacagaggcagatccaacaaacatatccnaagagatctcaaaaggatcttgtgggggtggaacagagtgttaatgaattggttggtcatttggtggagaatgatagcatccaagtagtttccatatctgggatgggtggtattgggaaaaccactcttgccagacaagtc

SEQ ID NO: 96 - DNA, 1503 bp, Canola (Brassica napus or Brassica rapa)
gtctctctctaccattattctaacaagtgaaagacgaagaagagataatcagacccaaaaatggcgactctttcgtcctctctattatcttcttctcctctatgcaaatccagattctctccatcgagaactgacttcatctctttctcccctcgaagaactctctccgtcgcctcgccggcgattctctctctctccgtcaaacatcatcgctgcagaaactctttccaagtgagatcagtagctagtccggcggagacggcgtcggagttcgatgagatggtcctccgggacgaagaggaagtattacatgcttggagggaaaggaggagtggggaaaactagctgcgcagcttctttggctgtgaggtttgctaacaatggtcacccaactcttgttgtctccactgatccagctcattccttgagtgactcctttgctcaggacttgactggaggaatgcttgtgcctgttgaaggacctgaagctcctttgtttgctcttgaaataaaccctgagaaggctagagaagagtttcgcagtgcctctcaggcgaatggagggactggggttaaagattttatggatggtatgggacttggcatgcttgttgaacagttgggggaacttaaacttggtgagttgcttgacacaccacctcctggattggatgaagccattgccatttctaaagtcattcagtttttggaatcacctgagtataacatgttcaccaggatcgtgtttgacactgcaccaacgggtcatacgctgaggctactctccttaccagacttccttgacgcctccataggtaaaatcttgaagcttaggcagaaaataacctcagctacctcagcaatcaaatcagtctttgggaaagaagataacaagcctgatgctgctgacaaattggaacggctaagagagaggatggttaaagttagagagctttttcgtgacacagagtcaacagagttcgtcattgtcaccatccccacggtaatggctgtcagcgagtcttctagattaagtgcttcattgaagaaagaaagtgtccccgtcaaaagacttgttgttaatcagattctccctccatcctcctctgactgcaaattttgttccataaaaagaaaggaccaaatgcgagctcttgatatgatcagggaggattcagaactctcaggcttgacattaatgcaggctccgcttgtagacatggagatcagaggcgttcctgctctgcgcttcttgggagatatcatttggaaatgagaagaagaagaagcaaagttcagttgtattgagatagtagtgttgtttactacaacttacattacatagttttggaataaatattgcaattcttggggaccaaaagcttcaagatatttacaatagttatgcttagaagaaaatatttatagaacaatgtttatgacactctaattagccataaaaatgaacttggaaacaaaaaaaaaaaaaaaaagggcggccgc

SEQ ID NO: 97 - DNA, 667 bp, Canola (Brassica napus or Brassica rapa)
aaaaatgaaaagtactctaacacttgtgagcggactatcatttaaaacaggaaactggtatgacaatgactaggagcttgcgattctctgcgatgatgatgttggtgttatcatcttctccagcactggcaggctctacgatttctccagctccagcatgaagtcggtaatagagagatacagagatgccaaatgtgacaccaattcggaaatgaacccagcttcagaaatcaagttttggcaaaatgaggctgcgattctgaagcgacagctacataacttgcaagaaaaccaccggcaaatgatgggtgaagagctctctggactaagtgtggaagatcttcagaaactggagaatcagcttgagatgagccttggcgacgtacgaatgaaaaaggagcaaatgttagtcgaagaaataaaagaactcaaccgagagggtaatctcgtgcaccaagagaatttagagctccacaagaaagtaaacgtaatgcaccagcagaacatggagttacataagaaggtttcagaggttgagagtgtgaaaagcgcagacaaaacttctcttctcacaaatggtctagacatgggaggtaactcgagcgaacatgtccatcttcagctcagccaaccccagcagcatgatgagacacgttccaaagctatc

SEQ ID NO: 98 - DNA, 471 bp, Canola (Brassica napus or Brassica rapa)
  misc_feature (459)..(459): n is a, c, g, or t
agaataagataaaactcgtttttcttgatcagatttgttgatggtcatctaaaacttataacctctctttttgtgtgtgtctttattaatttaatttaattttacgttttggagaaatgaagttctgtaagaagtatgaggagtacatgcaaggacaaaaggagaagaagaatctacctggcgttggcttcaagaagctcaagaaaattctgaagagatgcagaagaagagatcatcagattgcttcaatcaatcaccaacatggcaacaactgtcctcgtgaatgcacagtttgtgatggaaccttcttcccggagcttctcaaggagatggaagatgttgtgggatggtttaacgagaatgctcagaagcttctcgagttacatttagcttctcgtttcaaaaggtgtcatacttggctcaaaggcaacaacaatcgcaaaaggagccatctcggtntgatccaagaag

SEQ ID NO: 99 - DNA, 747 bp, Canola (Brassica napus or Brassica rapa)
attcccgggcggccacgcgtccgcttcaataattttaatagatagtccccacatgttagaactaaagctggaaactcgcgcacgttatgcgcattttatagcaaacaccgcctcactttcaaactgtggagggcaaagaagaaggatggagaaaagggaagaaggaaggaagactcatgttaaaagagggttgtggaaacctgaagaagacatgatacttcgaagctatatcgacactcatggagaaggaaactgggcagacatctctcgtagatccggtccgaattcaaactctccacatacgttatgatacttcgaagctatatcgacactcatggagaaggaaactgggcagacatctctcgtagatccggattgaagagaggaggcaaaagctgtcggttgagatggaagaactacctaagaccaaacatcaaaagaggaggcatgacggctcaagaacaagacctcatcatccgcatgcataagcttatcggcaaccgatggtcattgatcgcgggtcgccttccgggtaggactgacaacgaagtcaagaactactggaatacccatttgaacaagaaatccagttccaggaaacaaaatgcaactgaatcagtggaagccactccatgggtcgacaagccagttatgtctacagaagtgagaggaagccatggaggaggagagggagaagagggcactaccactacctggatggaggagaccaacttcttcgcccgcata

SEQ ID NO: 100 - DNA, 784 bp, Canola (Brassica napus or Brassica rapa)
gaatcatcgtcctcgatctttacatgtcagctaatttcgtcgcagcatatataacaaagttcttttcccttttgtagttgagatcgtccagttcttcaggaacaaaagaagcttctttcttttggtctgcaagaatggctgcaaatacttcagcttgtccagcttttatgaaagcaacctctaacggagttttccaaggagataaccctatagacttcgcgttgcctcttgccattcttcagattgtcatcgttatcattctcactcgtctccttgcttaccttttaagaccccttagacagcctcgtgtcgttgcagaagtcattggtgggattatgcttggaccgtctcttcttggccgttccaaggcttttctagacgctgtgttcccaaagaatagcctaaccgttctagaaactctggctaaccttggccttctcttcttccttttcctcgccggtttggagattgacaccaaatctcttcgcaacacggggaaaaaggctttggggattgcactggctggtatctcactgccctttgctcttggcattggttcttcgtttgttctcagagcaacaatctccaaaggagtagacagtgtggcctttctcatcttcatgggtgtggctctctccatcactgccttccctgtgttggctcgtatcttggctgagctcaagcttctaaccactgagattggacgactcgccatgtcagcagctgcggtcaacgacgtggctgcttggattctcctcgctctagccattgctctctctggatc

SEQ ID NO: 101 - DNA, 458 bp, Canola (Brassica napus or Brassica rapa)
  misc_feature (446)..(446): n is a, c, g, or t
  misc_feature (457)..(457): n is a, c, g, or t
aaaaatctccataacacatttctcgttctttgtagctcgcttcatcttatctttctgtctctagagatggagggcgttagggcttctcttgcttgcgctcttcttctttttgtagtctcttcaatagcttctgcagccattgtcgaacacaccttcaacgtacaaaacttaaccatctctcggctgtgcaaacggcaagtgataacggttgttaatggaagcctgcctggaccaacggtacgcgtcaaggagggtgactcgctcgttatacatgtcattaacaattcccctcacaacatcacaattcattggcacgggatattccatagactgacggtttgggcggatggaccgagcatgataacgcaatgcccaatccagccagctggtcatcgctacgcttacaggttcaacatcacaggccaagaaggtaccttggggggggnacgcacattcnc

SEQ ID NO: 102 - DNA, 440 bp, Canola (Brassica napus or Brassica rapa)
atttaccaggacgaacagataatgaaatcaagaactattggagaacccattacaagaagaaagataaatctttttcgaaacaagacaaatttaaaagatcccggaaacaactaggtatgcaaccgcaaccacataatcaacgatctcagatggtatctcgaaaccacatgaatcacgacaacgagcaaaacatagcttcctctttctcttacccgactagtgtcattcacgaccaatttcatatgcctcaaagtgttacagcaacctcaagcgatcactccatgaccgatgaaggtaacttgtggggcagcttgtggagtctaaacgatgaagatcgtccacaccgatttggtggtggctgggaacagagaatagctgctgatatttctgagaagtttaatggtgacagaattgaggctccgccgtgtggatcagggtag

SEQ ID NO: 103 - DNA, 853 bp, Canola (Brassica napus or Brassica rapa)
  misc_feature (13)..(13): n is a, c, g, or t
  misc_feature (25)..(25): n is a, c, g, or t
atttttggttatnagtttggtagtnaaatataggttgttagttagtataaacgaaacatcctaccggaaccctcttccttccttgcaaaataaaacacatccaattcctcttccctgagcttgaagagaagaagcgattaaagagagagagagggagagatgggaaggtcaccatgctgtgagaaagctcacatgaacaaaggagcttggaccaaagaagaagaccagcttctcgttgattacatccgcaaacacggcgaaggttgctggcgatctcttcctcgagccgcagggttgcagagatgtggtaagagttgtaggttgagatggatgaattatctaagaccagatctcaagagaggtaatttcactgaggaagaagacgaactcatcatcaaactccatagcttattcggtaacaaatggtcgttgatagctgggagattaccaggaagaacagacaacgagatcaaaaactattggaacactcacatcaagaggaagcttctcagccgcgggatcgacccaaacacccaccgtccgatcaacggatccgcaacccctccttccaaaacgacgactccgtctcttctacacgacgagccggttcaattcgatttagccaaaccggatcaacatcaaacggttaaaccggaaccaacggtgctataccgcgaagagggtgattataataacaataactgcacgagcagcgaaacgacgtcggaagaggattgtgtactcaatttagaactctctgttggtccggctactacgaggagttaccggtacgagtcaacccggaaggcaaatcttgactcgatcgagtccactggacggtggggatccgagt

SEQ ID NO: 104 - DNA, 1111 bp, Canola (Brassica napus or Brassica rapa)
  misc_feature (173)..(173): n is a, c, g, or t
gtgaaaaggagaatgtgaagagagggcaatggactcctgaagaagacaacaaactggcttcttacattgctcaacatggtactcgtaattggcgtctcatccctaaaaacgctggattgcagagatgtggaaagagttgtagactacggtggacaaactatttgcgtcctganctgaaacatggtcaattttctgaggctgaagaacatatcatcgtcaagtttcactctgttcttggtaaccggtggtcgttgattgcggcccagcttcctggtcgaacagacaacgatgtgaaaaattattggaacacaaagctgaagaagaagttgtcgggaatgggaatagatcccgtaacccacaagcctttctcgcatctaatggcagagataaccactacactcaatcctcctcaagtctcacacctcgctgaagctgccctcggatgtttcaaggacgagatgcttcacttgctcaccaagaaacgtgttgacctaaaccaaatcaacttctccaaccctaaccctaacaactttaaccgaaccgttgataacgaagctggtaagatgaaaatggatggtttggagaatggtaatgggataatgaagctatgggacatggggaatggattctcctatggatcttcttcgtcatcgtttggaaatgaagacaaaaatgatggatctgcgtctcctgcggttgcggtgtggaggggtcagggtggaatacgtacagcggtggctgaaactgcggcagcggaggaggaagagaggaggaaattgaagggagaagtggtggaccaagaggagaatggatctcaaggaggaagaggagatggaatgttgatgatgaggagccagcatgatcaacatcaacatcatgtgtttaatgtggacaatgtcttgtgggatttacaagctgatgatctcattaatcatgtggtttgattcattttggatcacattggtagttaacatttggttatgactgattaggtgttatctgttttcagagattgaataagttttttgctttctataaaaaaattatttagtaatgaaaaattgtaaatacataatttcttttataatatttccatcttccaaaagaaaaa

SEQ ID NO: 105 - DNA, 802 bp, Canola (Brassica napus or Brassica rapa)
agaccagaagtgaaagttctattaagatccagattacccaaccagaagtatcagtcgaaacataatctcctagcccctcgtcagatgaaaccagagacattacgtttccccaaccccaaccatcaaagtccatcaaatcagagaagagatactcagactgaattttatcaaaatcgattttaagatctcccaacaacgaaggagaaccagcttgatgatcaatcacgttttccttcacagtaagaagactggtactaccaatactactctgattctgaaatgtcagagcctttgggcacctaatcgcctttggacgtataacacatactttattcatgttgttgttgttggaatgttttcgacttttctgttggttggtttgtgattttggaagtcttttgcggaggtttgagttccagtggttctttatttcattgtctgttcgccctggaagcctcccagctatcaacgaccatctgtttccaaggagattatggaggcggattataagttcttcttcatcagatgagatgtttccgcgctttatgcctggtctcaagtagttcttccaccgaagtctgcagcttttgccacacctcttgagaccagcttggtttgggagtgtgctccattttccttcgccgtggaacatgatatagtctttaaggatcttgtcttcttgatcggtcccagctcctctgtttaactcctctttcttccccctactcctttctctctttctcatcatctctcttgttgttgtgtggttggtagacttgtctttagcgttgtgttgagaatc

SEQ ID NO: 106 - DNA, 430 bp, Canola (Brassica napus or Brassica rapa)
ttcgaaaccataatacttcacacatgtttcataatagagtaaatggcgaaaacgacaatctggagagaagctaaagcatagacagaggaaagggttctggtcacctgtatagaagacgagaagctaagcagattcatcctctctcatggccattcttgctggaccactgttcccatcaaagctgggttacaaaggaatgggaagagctgcagactaagatggattaattacctaagaccaggattaaagagggatatgattagtacagaagaggaagagattatcttgacatttcactcttccttgtgtaacaagtggtcgatgattgcgaaatacttaccgggaagaacagacaacgagataaagaactattggcactctcatttgaaaaagagatggctcaagtctccatctatttcctcttcttctg

SEQ ID NO: 107 - DNA, 750 bp, Canola (Brassica napus or Brassica rapa)
gaaagaagacaattttcgatggttggttcaaaaaaacgaagaagaagaagaagacaattttggatcttccagaggatttggttgaggatgagataatatctaggctgccgatttcatctctgaggtcagtgagatcaacctgcaaaaagtggaacactttatgtaaaaatcggatcttatttggtaaagcagcaaagaagcagttcttgatgatggactcgaggaggatttgtttgatgaacttggatctcagcaaagacaatggcgacccatctataaaacaggtaagcgtacttgatcaaaaattccagatacctatggtgtttcagagtgatggcttgctactatgcgtccttaaggattactctaggcttgtggtatggaacccttacttagggcaaatgaggtggatcgaacccagaaacagtttccatagttcagacaggtttgctcccggacacgacagcaactttaactacaagatcctgaggatctccagtgagattcatccagttacagaaagaaaagtttttagggttcgaactctacgatttcacctcgagttcttggaaggttcttgatgatgtcactcccaagcggcggcagataaggtctggtcaacagggcgagtctttgaagggaaacgcttattttcttacgagtgttagaggttccttccgcgggtttggatttcacaacagagaggttcggaccgcctcggcctcggccgccgttcattcttacgatgga

SEQ ID NO: 108 - DNA, 903 bp, Field mustard (Brassica rapa or Brassica campestris)
  misc_feature (5)..(5): n is a, c, g, or t
  misc_feature (47)..(47): n is a, c, g, or t
  misc_feature (730)..(730): n is a, c, g, or t
  misc_feature (786)..(786): n is a, c, g, or t
  misc_feature (805)..(805): n is a, c, g, or t
  misc_feature (807)..(807): n is a, c, g, or t
  misc_feature (814)..(814): n is a, c, g, or t
  misc_feature (823)..(823): n is a, c, g, or t
  misc_feature (834)..(834): n is a, c, g, or t
  misc_feature (841)..(841): n is a, c, g, or t
ttganaagctttcgcctgcaggtaccggtccggaattcccgggtcgncccacgcgtccgaacgacttctccggtggtaatcttgcaatgaccacaccttctagttgtctagacgaaccagggtttctacagtcctctgaaaacctcggttctgagaaccaacaatccaataatacctttgtgaaggtgtacaagtcagggtcttttggacgatcactagatataacgaagtttagcagctaccacgagctgcgaagcgagcttgctcgcatgtttggcctagaaggccagttagaagaccctgtgagatcaggctggcagcttgtatttgtcgaccgagagaacgatgttcttctcctcggcgatgacccttggccggagtttgtgagcagtgtgtggtgcataaagatactgtcaccacaagaagtgcagcagatggggaaaagaggccttgagcttctcaactcagctcctccatcctcgaacaacaacgtcgtcgagaagctcccgagcaataacgggaactgcgatgactttgggaaccggtcagacccgaggaaccttggtaacggtattgcatccgttgggggttcgttcaactactagagaagaaaaaccccttttcttggtaatcaaggtattattgttttatcaaaaatagtatttagatcttctttagtttttaattactaagtaagctaaactgtctttattactttccaaaaagggangctttgcgtttggcctttgtgggagaccaaaaaaaaactaaaactattgtaataanctcttattctttgcggtcngnatactgnaaatataanaactttttggnctttttnttaaaaaaaaaaaaaaaaaaaaaaaaaaggggggccctttttagggtcccagcttactccct

SEQ ID NO: 109 - DNA, 670 bp, Field mustard (Brassica rapa or Brassica campestris)
cccacggtttggaggtgagagagagagagagaagtagggttggtcaatcgtagcatccccggtgtgagatagccgtttttccggattcattatggtgaggaagaagagaactgatggtccatctgaaggaggtgaagggtctggttcccgtgctgctccagcctcaggtggtggacgtggtggttatcagcaggggagaggaggaggcggaggaggacagcagcaaggtggaagaggctatagtcctcagtctcaacagggaggtcgtggtggtggtcgtggatatggccaaccacaacagcagcagtacggtggtcctagagaaggccatccaccacaacagcagcagcagcagcagtacggtggaccaagaggtggccaaccaccacaacagcagcagtacggtggaccaagaggaggtcaaccaccacaacagcagcagtacagtggaccaagaggaggccagccaccatcacagcaacagtatggtggttcaagagaaggccagccaccacaacagcagcaccaacagtacggtggaccaagaggaggacctcctcgtggtggtggccgtggaaggtgcatcctctgctggactgccgcagagacaatcagttcccgagctgcatcaagctaccttaccaacttatcaagcggtgtcttctcagcc

SEQ ID NO: 110 - DNA, 305 bp, Field mustard (Brassica rapa or Brassica campestris)
cagttttcaggtttcccaatcccaactcagactaaccgagctatgcttgttcatggtcagtccaatgacatgcatggaggtggggagttgcaccatttctctgtccatatctgagacattggatcttttggtgctgtttcaatgtttcccacctaaaggggaagtcatccttggctactactactagttctcttgcttgttgttacttttttatgtttcaatttcactttatgtatgtgttaaaatatcacaacaagaacaagaaccaccgcaatcttcagtttggaacacacttttaatcttcc

SEQ ID NO: 111 - DNA, 405 bp, Field mustard (Brassica rapa or Brassica campestris)
aaccatatcccaaattcaaatctccaatttccgggcagcagcaacattggtggcggaggaggattctcactatttccggtggctgagaaccaccggtttgatggtcggaccacgacgaaccaagtgttggcaaatgctgcagcatcatcaggattctctcctcatcatcacaatcagatttttaattccacttctacttctcatcaaaattggctgcagaccaatggcttccaaccttctctcatgagaccttcttgaatatctaatatttttatctttcatttttatatatgtgaaacaaattcggggaaaaatgaacctttaaaaccacccctatggtcttgggtcactaaaattaattatcggcttttcgtgttaaaaaaaaaaaaaaaaaaaaaactccga

SEQ ID NO: 112 - DNA, 740 bp, Field mustard (Brassica rapa or Brassica campestris)
cggttcggatccggttaacgtagaccggcaatggatggctacttcttcatcgcctgctcaaatggagtatttaacctcgggtttgatactcgggtcgggtcaaacccatttcccgattcaaacaagtgctcaccctttctccgaccatcatcatcatcctcaagagttttccttcgttcccgaccatctgatttctccggcaggatccaacggcggtggagcgttcaatcttgatttcaacatgtcgtcgaccacctccgccgccggaaccgccgggttcagtggtttcaacagggggacccttcagtccaattcatcaaaccatcatcagcagcagtcttttctcgctaatctgcagaggttttcatcatcagaaggtggtggaggtccacagttcttgttcggtgcactgcctgcagagaatcaccaccccaacagtcaccagtttcagctttattatgaaaatggatgcagaaactcagaccaaaagggcaaaggcaagaactgatgatactgttaccatttgcatcttttgtttgagtttctttgttttttttcttttcttgcttttatttatcacccaaatgtcaaatctcgctcctcttggtttatctttcggatcatcatcatcctctcaatgtgtgtgttaaatctgtttgatacgatggtctaatttggaaatcttttcagattgggtttgtaatgttgtatttgtgataatagaattttgtttgggcttc

SEQ ID NO: 113 - DNA, 416 bp, Field mustard (Brassica rapa or Brassica campestris)
cccacgcgtccggttgaatggttgcaaaaagatgaggaagctagcagattagggatagtccgtttggggacgcggcgcttcttgctgatgtgaacaagtatgaaacaatgcgatccctttggatgtcgtcatgcgaagtcactcttgggggatgcaaaaggcttgcacggaaagcgccatggctcaatgtacagatcattaacgagaacgataataaccggatggaggagaatggatatgagggaagacagaaggtggataaactttatctctaccggactgtggttgggacaagggttgatgcgccaccatttgtgtggattctctagtttttttttcgttccgaccaaacatggaactggttcaatgcttctgagatctgattggcggcttacgttcgtggcctttccaaatta

SEQ ID NO: 114 - DNA, 688 bp, Field mustard (Brassica rapa or Brassica campestris)
cccacgcgtccggcctgagagagaagcttcaatggcgtccatggctgcagccctcaacaaaactcctttcctctctcagccactcaccaaatctccatcctccgatctccccatcgccgccgtttctttcccgtcgaaacctcgccgtcgaaacatcaccgttcacgccgggctgatcacgcccgacggcggaaagctcgtagagcttatcgtggaggagccacgacggcgggagaagaagcacgaggcggcgacggagctgccgcgcgtggagctgacggcgatagacatgcagtggatgcacgtcttgagcgaaggctgggcgagcccactcggagggttcatgagagagtccgagttcctccaaactcttcatttcaactcgcttcgtcttgacgacggatcggttgtcaacatgtcggtgcctatcgtcctcgctatagacgacgagcaaaaggctagtatcggcgagtctaagcgcgtcgcgcttgttgattccgacggtaatcccgtcgctatcctcaccgacattgagatttacaagcatcccaaggaagagcggatagctagaacttggggtacgaccgctccaggtttgccttacgtagatgaagccataaccaacgcaggaaactggctcatcggtgggtgacctttgagggtctagagccagtcaagtcaatgatgg

SEQ ID NO: 115 - DNA, 485 bp, Field mustard (Brassica rapa or Brassica campestris)
cccacgcgtccggcttgtaagagacacaacaacaagacaacttccctcaatggcttcttcagccgccatcgtcttctccggttctccttttcgatcatcaccaatcactagccatcgtgtttccctccacgcctctagacccgtctctctccgtcgaggcggagtcttttcccgccgcggtctcgccgtgaaagcggctctgatcgagccggacggagggaagctcatggacctcgtcgtcgaggaatccaaacggcgcgtgatgaaacgcgaggcggagacggttcccgtaaggatcatgctgaatcgcgtggacctcgagtgggtgcacgtgctcagcgaaggctgggcgagcccgctccgaggcttcatgagacagtcagagttcctccaaacacttcatttcaactcgatccggctcgaagacggctccgtcgtcaacatgtcggttccgatcgttctcgcgatcgacgacgagcagaaaa

SEQ ID NO: 116 - DNA, 497 bp, Field mustard (Brassica rapa or Brassica campestris)
aacaaacattttctctcaaatctcaactcggaagcctgagagagagagaaccttcgatggcttccatgtctgccgtcctcagcaaatcccctttcctctctcagcctctctccaaatctccatcctccgatctccccttctccgccgcaaccgtctctttcccctcgaaatcgcaccgtcgcggcggagtaatccgcgccggactcatctcccccgacggcgggaagctcgtggagctcgtggtggcggagccgcgacggcgggagaagaagcacgaggcggcggagctgccacgcgtggagctcacgtcgatcgacgtgcagtggatgcacgtgctgagcgaaggctgggcaagtccgctcggaggcttcatgagagaatccgagttcctccaaactcttcatttcaactcgcttcgtcttgacgacggattccgtcgtcaacatgtccgtgcctatcgtcctcgctattgaccaccaacagaaggctagtatcgg

SEQ ID NO: 117 - DNA, 517 bp, Field mustard (Brassica rapa or Brassica campestris)
gacttttgaacgacaccgttttggattgcctagacctctctctctctcccatggccaccgtcgggcttcttcggtctctccgccgccgagaagtctacgtagtttctgtctcttcggcgtatagattcagttctgctagcgccggcgggaggacgacggagctccggttacccggagtcaaagatataatcgccgttgcgtctggtaaaggcggagtaggaaagtcttcgactgctgtgaacttagctgttgcattggccaacaaatgtgaactgaagatcggattgcttgatgcggatgtgtatggaccttctgttcctatcatgaggaacatcaatcaaaagcctcaggtcaaccaagatatgaagatggttccagtggagaactatggagttaaatgcatgtccatgggactccttgttgataaagatgcaccacttgtgtggagaggtcctatggtaatgagtgctcttgctaagatgactagaggagttgattggggagatctcgatcttct

SEQ ID NO: 118 - DNA, 654 bp, Field mustard (Brassica rapa or Brassica campestris)
gaacaatttgacttttgcttcctttttacttttgttttccgccgacatcaccatcttctttctttctccttcttcctctgtttttcttctataaagccaacacgagacgcaagtgagagagatagaataagataaaactcgtttttcttgatcagatttgttgatggtcatctaaaacttataacctctctttttttttgtgtgtgtttattaattttttttttgacgttttggagaaatgaagttctgtaagaagtatgaggagtacatgcaaggacaaaaggagaagaagaatctacctggcgttggcttcaagaagctcaagaaaattctcaagagatgcagaagaagagatcatcagattgcttcaatcaatcaccaacatggcaacaactgtcctcgtgaatgcacagtttgtgatggaacgttcttcccggagcttctcaaggagatggaagatgttgtgggatggtttaacgagaatgctcagaagcttctcgagttacatttagcttctcgtttcaaaaggtgtcttacttggctcaaaggcaacaacaatcgcaaaaggagccatctcggtttgatcacagaaggcaaagacttggttagctacgccctcatcaactcggtcgccattagaaaaatcctcaaaaa

SEQ ID NO: 119 - DNA, 778 bp, Field mustard (Brassica rapa or Brassica campestris)
actcaccttctctcactcaagggtccaaaaagtgtttttctcttttgtgttcttctcttttctcttttttgagagaagagatgggaagggctccttgttgtgagaagataggactcaagagagggagatggactgccgaggaagatgagatcctcactaactatatccaaaccaatggggaaggttcttggcggtctttgcctaagaaagctggattgttgagatgtggaaagagctgtagactaaggtggataaactatttgagaagggacttgaaaagaggaaatattacagccgaggaagaagaaaccatcgtcaagttgcattcccttctcggcaacagatggtcgcatattgcaacacatctaccaggaagaacagacaatgaaattaaaaactattggaattcacatctcagccgcaaaatctatgccttcactaccgtcaccggggatgagcacagtctaaaggttgacgatttagtcctgaataaatcttcttcttcttccttgggagccaagaacacgaacaagaccaagaagaagaaaggaagaactagtaggtcatccatgaagaaacacaagcaaatggtgacggcctcacaatgtctcccacaacctaaagagctagagagtgagatcagtgagggatggaacagcgggaactacgaaggaaagtcgttgggagcgtatgaatggttggatggtgagatagagcggctcatgagtagtttcgtctgggaatgtgctagtgaaagagggctgtgattagcatgaat

SEQ ID NO: 120 - DNA, 704 bp, Glycine max
ccgggttaacggcggtgacggtgccgaggtgtcaggtagaggggtgccacttggcgctgctaaacgcgaaggattaccaccggaggcacaaggtgtgtgagatgcactcaaaggctcccaaagttgtggtcttaggcatggaacagaggttctgccagcagtgtagcaggtttcacgtggtgtcagagtttgataattcaaagaggagttgtaggaggagactagctggtcacaacgagagaagaagaaagagctcccatgattctgttgcaaggaattcttcaaaaggagggtgtgctctctctcttctgtcatcaagaagtgattcttggctttctccttctgatctctccataagatgcagtgccgcattgcgtgaattgatagccgaaaaccgggcagccatcatggccagacaatttgtttcagatagagattggcataatcatcaccatgcagtggaagacttcaaggagatccaacctgagtccaattacttcccacaacaaatgtttccccagacacaatgaaggatccatgtgtaaaagagcttgagatcttaatgctggttacttgacccaaaggtttagggaaacaagatttcaaagagagtagacatttatggggaatgcctaaagaaaggactttgtgtctgaagttttcaattctttaatttgctaaaaataaaagtttggacttcttta

SEQ ID NO: 121 - DNA, 895 bp, Glycine max
ccaccactcacaatggagatcaagagtagagagaggatacaagtgtcaattgaaaaggtgaggagagacagcacagttgaagttgaagatgaagaagaggaggatgaaagtgtggttggtggtgagggtggtcttgcagaagatgagaagaagaaaggtggtggagggagtgggagaagagggtcaagtggattttttccaccttcttgtcaggcagagatgtgtggtgctgatttgactgttgcaaagaggtaccatcgccgccataaggtgtgtgagcttcattccaaggctccttctgtgatggttgcaggactgaggcagaggttttgccagcaatgtagcaggttccaagagctggcagagtttgatgaagctaaaagaagctgccggagacgcttggccagacataacgagcggcgccggaaaagcaatgctgaaacttgcaatgaaggatgcagtggaagcaaagggcagcaccctacagaaagccactgcagaaatgctgatgtctggggaagaattcagatgaacattgcaaagaattctggctacaactccttccatattagatgaatccaatgtgttcaccggcatgctccctctcttctgtcaatggatcttcacagtttacatgccaaggcatataataaaggcccctttctttatgttacgagaataagcatctaaaccagaatgaagaactcccaacatctaaaggtggtgtcgtatgtataatactagttcatttcccttaagctctatattatatgtacttagccagtttcttctgtatctgtgtgccttggaatatatgtattctattgtgcccccccttaaaatggtgtacccctatgcccccttgattagaataaaatctattgcttctttgact

SEQ ID NO: 122 - DNA, 781 bp, Glycine max
gaccctatgtggtcctcgctcattaattctctcatatcattcattcctttttatatcaactatttatatggtcatgttttccttatgtagcggcggagccttttttttcttctcataaccttcttctggagctctgtggaagttactatggacacaagcaggtctgagggaaaaagggtcatgaggtacaaagaagaagatgatgataatgatgatgaagaagaagaagaggtggtgagtgagatgggttttgaagaagatggaaggaggaataagagagtaataagagatctctatggaaagagagggtccaaaggtggaggctcaataacaccttcttgccaagtggacaattgtgatgctgatctgagtgaagctaagcagtaccacagaagacacaaggtttgtgagtaccatgccaaggctccttccgtacacatggcagggctgcaacaaaggttttgccaacaatgtagcagattccatgtgctatcagaatttgatgactcaaagaggagttgtagaacgcggttggctgggcataatgagaggcgtcgcaaatatgcagttgactagctaccatggacaatgatttcttctatgggatggacattaataatcattgaggcaagcatgtgattaatgaaattaaatttcccattcaaatcttcataaatcattgttgctggtctctaaggatgctctctatcttctgtcaagattttcatatgcaaagatttttctgttagttaaaaaaaaaaaaaaaaaaaagggcggccgc

SEQ ID NO: 123 - DNA, 1031 bp, Glycine max
ccacgcgtccgtacggctgcgagaagagacagaaggggctccaaacggtcctagctcaacaacaagcatatccttcatcattgtcaccacccctttgcacaatggagagggagagagcattgtttgagagggtgagaaagaatagcacagtggaagaggaagtggaaaatgaagtagaggaggaggatgaaagtggcgttagtattactgaagaagagaagaagaaaggggttggtagtagtggtgggagaagagggtcaagtggaggtagtggaggggtttctccaccttcatgtcaagcagagaggtgtggtgctgatttaactgatgcaaagaggtaccatcgccgccacaaggtgtgtgagtttcattcaaaggcacctgttgtggtggttgcagggctaaggcagaggttttgccagcaatgtagcaggttccatgacctggcagagtttgatgaatccaagagaagctgccgccgccggttggccggacacaacgagcggcgccggaaaagcaacccggaagcttccaatgagggcagcaccaaaggccatcaccctaaggaaacaacacactgcaggcttgcaaatgagagggagagaattcagatgaacctaccagggagttccggctacaagtctttcaacatcagatgaagccaaagtgttcacaaagctctctctcttctgtcaccctttggtttcttacaacccaaggtatataataaaaacccctttgtattgtatgttcacatgagcaagaatcaaaaatcccaaaaacttccaacagccaaagcctgatgtcttaatatgcaatgtaagctagctagtttcctgagctctgtttttcttatttggatagagtgccttttttttctgtttgccttatcaccattgttatcctatagaagcacccttcttgattggggtgtgctcttatcttccattgggttagaataaaaagatattgcttcttttgggtaaaaaaaaaaaaaaaaaaaaaaaaaaaaaagcggccgctttagagga

SEQ ID NO: 124 - DNA, 666 bp, Glycine max
caaagatggtggtgaggagtgacaggttgaagagggatgtggcagattgtggtgacaacaaccaaaacgggtacgtggagcaagagaagaagataaaaggggtggtgagttgtgctgggaagaaaggtggtggtggcaataataatagcatatatgcggtgttgtcaacgccgatcttcatgaggccaagcagtaccacaggaggcacagggtgtgtgagtatcatgtaaaggctcaggttgtgcttgttgatgaggttagacaacggttctgtcagcaatgtagcagattccacgaattagctgaatttgatgacacaaaaagaagttgccgcagcagtttggccggacacaatgaacggaggagaaagaactcagatcagtctcaagcagaagggtcaagccgcaacaaagggacagggcaccctcaattgaaggacattacttgtggtcaggctgatgagagggggagaattcagataacaatccacgaaaatgctgcttacaaacatttccagataagatgagatatgctttgatctgaagtttgctctctctcttctgtcatccaggggatgtatttgtatttgtcaaactattcctgtgtcacactcatgctgaagattgcatttagataaataacttacaaaaaataaaactaacataa

SEQ ID NO: 125 - DNA, 641 bp, Glycine max
gccccccccccaggtgtgcgaggcgcactccaagggcccccgtcgtgctcgtcgccggcctccgccagcgcttctgccagcaatgcagccggttccacgagctgtcggagttcgacgacgtcaagcgcagctgccgcctgcgtctggccggccacaacgagcggcgccggaagagctcggccgacgcgcacgccggcggcggcaataatggattccgccaacacgccgaccagaacggccgcggcgacccggccgggaaccacttccagatcagataaagcatgctctctctcttctgtcatgcagcaggatatgctagcatcatcactaccgatagatatttatgcgtctatcgtctacccgccccgaaaaccctagttatatatatatatatatatatatatatatatatatatatatagacatatgctgattgtaacctaattagcctgcagccagttaagcagggactgcctactctgctaggaggacgtgtgtaatcatgtggcctgcgcaaacagtaatttgtgctggctgctgtgtattcatgctgctctgataatcgtgtcgtggtaataatatatcctatttattctactactagtaatatataccgattctccaaaaaaaaaaaaaaaaaa

SEQ ID NO: 126 - DNA, 933 bp, Glycine max
aatttcagaattaatgtatacacccactcactctagttagctagtactaaagggagcatcagcatcagcactcagtagccagcagcagcaatgggttctgcttcagtcaccaaagcaccaccctcttcctcctcatcacccaactcttcttctactgagtcccttgatggcttgaagtttggccagaaaatctactttgaggaagtgagtgttgctgcagcagcagcaacaacaactcaagggggcaacaaaacgagaggtggggtttctgcttcaaagaagggaaggggtggctcagtgcaagctcctaggtgtcaggttgcgggctgcaaagtagatctgagtggtgctaaggcttactattctaggcacaaagtttgtgccatgcactccaagtcccctactgtcactgttgctggtttggagcaaaggttttgccaacagtgtagcaggtttcatctgctttctgaatttgatcaaggaaaacgtagctgccgcaagcgacttgctggccataatgagcgccgacgaaagcccccaccaagctccatattaacctctcgctatggcagactctctgtgccctatttttgataacaatggtcgagacgatggctttctgatggaatttgcttcataccccaagcttactttgagaaatacattgccaactcaaagatcaactgaagccggctcctggggaaccatgctgcaacactcacctggcaaggaggttcagacactccctctgaatttttcctgcaaggatcagggagtagtggtggaacaagcttccttaattcaaaacatcccttagtggaaagttacactggagtcactgactcaaactgtgctctctctcttctgtcaagtcaaaccctgggtttcagaaacacagccccagcaacaaagtttgaactgaacaacaacttg

SEQ ID NO: 127 - DNA, 2655 bp, Glycine max
tccggtccgaattcccggtcgccccgcgtccggttgagaagaaaaaagaaaaaaagaaaaaagagagggtacaatctgtctctcgtagctggcttggctccattattcttggtttttggacagacaagggtgtgtttggttctctgactacactcactcactccttctctcttctctctcagtgtacctgactctgccaccttccctacccttccaccccctcttttgtcttccactttactctcccattacaactcctttcatgaacttctatttccaacttcaaccacctctttctctctcacttaactttcccttatcaaaacaaaccacaatgaataataatactaacgataacaatacactctagacacctcaccttatcactccatcacctatggcttcagacgcaaaactctcatcttctgagtccctcaacggtttgaaattcggccaaaaaatctattttgaggatgtgggttttgctactcccgctacctctcttacttcttctgctactactgctaccactgttacttcttcttcttcttcctcttcaagaaaaggaagaggtggttctgttcaaccagctcaacctccaaggtgtcaagttgaagggtgcgaagtagatctgagtaatgcaaaaacttactattctagacacaaagtttgtggcatgcactctaaatcccctacagtcattgttgctggtcttcaacaaaggttttttttttggagctgggatggctttctgttgactgttccaagagtattttgtgtcttctttttatctcatggctcttccactgttgtctaaggcaaaagttactcttttccttaatatgaaaaacaatactcttctgaatatgctaagataaaatacatattatgagaaagatagtaaacagatatttaagatggatttcttagcatccaatctccctgcatttcagatgtactatccgatggatacacattgtagtttatctcctttatttaagcttgatgacttctcttttgaattattctgatgtctttcactaaagagtaaatacaatgctatcccttttggtaatagagaagataaagaactttattggtattgttttggtcttattttactaatatgttaaagctgaattctaagtataatggagccacaggatgttacttgagcaatgtttgagaattgcttcagtaaaacagggctaaaggaacatgttagatgctcacatgatgtgcattactgcaagatgtgagaattattactacatcatatggaataccctttttcttgggtttatacatatttgcttatgttctgtaatcttagcaatgatgacaaaatcaaatcagttagaaattccgtctcatttgcatgtgcatttaatcaaacaagagatgcgtttaagtgcttccaatttgtggcaacaacagcttggcatgctaaggaaacagtagacttgtcatgttagtatttctagtcttggcacttgggtatgcttgtactcattcacctctctttgacataaaaaattggaaccatttatatttgtaaaagctaatatcatgtttcatagccttgcacaggtttcatcagcttcctgagtttgatcaaggaaaaagaagttgccgcaggcgactagctggccataatgaacgtcggagaaagcccccacccagctccctcttgacctctcgctatgctagactttcttcatctgcttttgatcatagtggcagaggtggcaactttctgatggaattggcttcatacccaaaacttagtctgagaaattcacttccaactcctaggtcatccgagctagcgcctggaaatcaaacctccaccctcagctggcacgggaactcggagacatcatctgaccttttcttgcaaggttcggtgggtgggacaagcttcgccggcccgggacatcctccaggggaaagttacactggggtcaccacctcgagctgtgctctctctcttctgtcaaatcaaacatggggttctagaaacccagcaccaagtcttgggttgaataacatggtaaatttccacgggacgcccatgacacagcctgctgcatcatctcatggtgcatcaatccatcaacttccaaataccccgtggtgtttcaagggcattgattctggtaactgttcgcccgagggggtccctgatctaggtctcggtcagatttcgcagcctctcagtagccaacttcacggtgagctggacctgtcccaacaaggcaggagacattatatggatctagaacagtccagggcatatgaatctgctcattggtcactttaatgcacttgtttttgtttttgtttttttgtcaggtttgtaataaaatgtagcacaaacctgtgcctacttggttactgaccagattgatgataactatttcttgttttggtttgttcaaactgataagcaaggtgggtagccttgcctcatttgtggaactttctggcggcgaatgaaatcacccgactgtgttttgttagtgtcttaaaaaaaaaaaaaaaaaataaaaaaaaaaaaaaaaaaggtacggtgtcttctgccattgctgtcacctctttgctgtttgctacccctgctccaagttatttgatattatcttttgactatctgtc

SEQ ID NO: 128 - DNA, 1591 bp, Glycine max
tacgtaggccccccccccactcctttcatgacttcaacttcaacaaccacctctttctctctcacttcttctcttgctcttatcaaaacaaaccactatgaataatactaacgataataatagttacaacaatacactctagcttctagcctgctacctttccttatcaccagcaccaatggcttcagacgccaaactctcctcttctgagtccctcaacggtttgaaattcggccaaaaaatctattttgaggatgttggtcttgctactccagccacctctcttacttcttcttcttcttcttcttctgctgctactgttacttcttcttcttcttcaaggaaaggaagaggtgggtctgttcaaccagctcaacctcccaggtgtcaagttgaagggtgcaaagtagatctgagtgatgcaaaagcttactattctagacacaaggtctgtggcatgcactctaaatccccttcagtcattgttgctggtcttcaacaaaggttttgtcaacagtgtagcaggtttcatcagcttcctgagtttgatcaaggaaaaagaagttgccgtaggcgactagctggccataatgaacgtcggagaaagcccccaacaagctccctcttaacctctcgctatgccagactttcttcgtctgcttttgataatagtggcagaggtagcaactttctgatggaattgacttcatacccaaagcttagtctgagaaattcacttccaactcctagatcatctgagctagctcctggaaatcaaacctccacacttagctggaatggcaactcagagacatcatctgaccttttcttgcaaggttcggtgggtgggacaagcttcgccagcccgggacatcctccaggggaaagttacattggggtcaccgacacgagctgtgctctctctcttctgtcaaatcaaacatggggttctagaaacacagcaccaagtcttgggttgagtaacatgataaatttcaacgggacacccttgacacaacttgctgcatcatctcatggtgcatcaatccatcaacttccaaatacctcgtggtttttcaagggcattgattctggtaactgttcgcccgaggtggtccctgatctaggtctcggtcagatttcacagcctctcaatagccaacttcatggtgagctggacctgtcccaacagggcaggaggcattatatggatctagaacagtccagggcatatgaatctgctcattggtcactttaatgcacttgtttttttttgtcagctttgtaataacatgtagcagaaacctgtgcctacttggttacttaccagattgatgataactattgcttgttgttttgttttgttttaactgataagcaaggtgggtagccttgcctcatttgtggaactttcaggcaccgaatgaatctcacctgagagtgtgttttgttagtagtgtcttaagcacaggtatggtgttttttgccattgccgtcacctctggaattatttgtgattgggaggacagcctctttgatgtttgctacccccgccccattttatttgaaattatcttttgactatctgtcc

SEQ ID NO: 129 - DNA, 1587 bp, Glycine max
  misc_feature (1568)..(1568): n is a, c, g, or t
gaattattctggtgtctttcactaaagagtaaatacaatgccatcccttttggtaatatagaagataaacaacttcattggtattgttttggtcttattttactaatacgttaaagctgaattccaagtatcatggagccgcagaatgttacttgagcaatgtttgaggattgcttcagtaaaacagggctcaaggagcatcttatactgctaatatgccatctcattcaatgccaaacaagctcacatgatgtgcatcatatggaatacccttgttcttgggtttatacatattgcttatgttctgcaatctttgcaatgatgactaattcaaataagttagaaattccatctcatttgcatctgcatttaatgaaacaacaaatattttaagtgcttccaatttgtggcaacaacagcatgtcatgctaaggtaacagtagacttgtcatgttagcatttcttaagtcttggcacttgggtatgcttgtactcattcacctctctttgacataaattggaatcatttatatttgtaaaagataatatcatgtttcatagtcttgcacaggtttcatcagcttcctgagtttgatcaaggaaaaagaagttgccgtaggcgactagctggccataatgaacgtcggagaaagcccccaacaagctccctcttaacctctcgctatgccagactttcttcgtctgcttttgataatagtggcagaggtagcaactttctgatggaattgacttcatacccaaagcttagtctgagaaattcacttccaactcctagatcatctgagctagctcctggaaatcaaacctccacacttagctggaatggcaactcagagacatcatctgaccttttcttgcaaggttcggtgggtgggacaagcttcgccagcccgggacatcctccaggggaaagttacattggggtcaccgacacgagctgtgctctctctcttctgtcaaatcaaacatggggttctagaaacacagcaccaagtcttgggttgagtaacatgataaatttcaacgggacacccttgacacaacttgctgcatcatctcatggtgcatcaatccatcaacttccaaatacctcgtggtttttcaagggcattgattcyggtaactgttcgcccgaggtggtccctgatctaggtctcggtcagatttcacagcctctcaatagccaacttcatggtgagctggacctgtcccaacagggcaggaggcattatatggatctagaacagtccagggcatatgaatctgctcattggtcactttaatgcacttgtttttttttgtcagctttgtaataacatgtagcagaaacctgtgcctacttggttacttaccagattgatgataactattgcttgttgttttgttttgttttaactgataagcaaggtgggtagccttgcctcatttgtggaactttcaggcaccgaatgaatctcacctgagagtgtgttttgttagtagtgtcttaaacacaggtatggtgttttctgccattgccgtcacctctggaattatttgtgattggnaggacagcctctttgatgt

SEQ ID NO: 130 - DNA, 2906 bp, Glycine max
tacggctgcgagaagacgacagaagggggggaattcgcattttgtaaatgatatagtcaaaactaatttacacttaccatttgctatttgctaagtacatattttctttgcttgtttaagtttttggtctagcaggaaatacagctgacatggggatagaacaagtgcatttaatgtcgtctttgaaaaattagtcgatggttttcccatagggattagcagttcagttcatagattctgaaaatttggggatgtttcttaaactctagcttcttaatgtgttctttaatcattggtctaccccatttatacagtttgcagatcacagtgacctacggctgcgagaagacgacaggggggaattcgcattttgtaaatgatatagtcaaaactaatttacacttaccatttgctatttgctaagttcagctacgtaggccccccccccgtttttggtctagcaggaaatacagctgacatggggatagaacaagtgatttaatgttgtctttgaaaaattaatcgatgttttcccttaggaattagcagttcattcatagattctgtaaaatttggggatgtttcttaaactctagcttcttaatgtgttttttaatcattggtctaccccatttatacagtttgcagatcacagtgaccatttgtgtatgaatttctaaggtcttgtcatggagtgtaatgcaaaatctctcgggcaatgggactgggagcacttattcttcttcaatacaaaagcagctgaaaatccaaggttacaaccaactgattgtagcagtgaagcagatcgggaaatcaacgttggaatgttgcatccatcaggtggtagtgcttgttctggctctgaactaatacatgcttcttcatcaaggagctcaaaatcagcttccaacaattcatcatcaaatggggatagcaaggcatctatattgactctggaaggttctcatgatgattccactgggaagaaagaattgtgcaatggagagccaattgaaacttctcctgcagcagtgccctctcctgtctctggtgaaccgttgctcactctaaagcttggtaaacgattgtactttgaggatgtctgtaccggaagtgattccaagaaaccatcttcctttgacattcccatttcatcaggaaagaaacataaaaccagtagtcagactttacagcatccaagctgccaggtggaaggctgtggccttgacctctcatctgctaaagattaccatcgcaaacaccgagtttgtgaagctcattccaaatcccctaaggtggttataactggtttggaacgccgattttgccagcaatgtagcaggttccatgctctgtcagagtttgatgacaaaaaaagaagctgtaggcgacgtctttcagatcacaatgcaaggcgccgcaaacctcagcctgactcaatccaattaaatccatcagctttgtcttcatcaccctatgatgggaggcaaatagtgagtccatttgcattttcaaggactgccacaaatttagcttggcaagatatgcacccccagacaaaagaatttctcccgaagcctgcaaaagccttcaataagataccgagtattgtctccatgctttctgatgattccagtggccttctaacatctagaggcatagcaacgaagagtactgttccagatgttgcaggtatggaagatcccattaggttgtctgatccaaacggtacacaagatgttaaccgtgctctctctcttctgtcaacgaattcttcatcttcatggggtgcatatgagactaagtccctttctttggaacactccactcgggcaacacactcaatcactcagcatcacttaccacttccttcctcggcagagtattggcacactgatcatcaacaacattcaagcatgtgtatctcattcacggattgcgatagcagcaatcgctttcaagactttcagctgttgagctcaccctatgaatcaccttttccttgcaaccaactggattaacaacactatgcttctacttcaacaaaatttctagggtgctgtctttcatttgcttgctttttcaaatggagattaattaaaactgcatgttgattgcagttcgaatggtgtaagacctgttctcttgaaaactcccaagacattttcattttgtaccagactgcgctcatttcaattttaactttaatttctacttaaaaaaaaaaaaaagaaaaaaaaaaaaaaaaaaataccttagcttcttacctatgttacgcacatctccctacttcataatactatttactcacatcccaaaacaaatattgcatttgattttttaatataaattaattattctttttcatcatccccctatggtaaaacaggatcattcccctcccttggaaaatctatggcctgtcttgctccctggttaagtttcccagttaattattttgggaggcatattatacaaatcatgataattcccccccatttttgaatgatcatatcaggttgggaatttgtttccctttagtttcaaactgtctagtattagcttatttcaacttttgttaaccaaaagaatttagtaaaaaaaaaaaaaaaaaaaaaaaaaaaaaatgggtaaatgatataggggaagctgatttacacttaccacttgctatttgctaagtacatattttctttgcttgtttaagtttttggtctagcaggaaatacagctgacatggggatagaacaagtgatttaatgttgtctttgaaaaattaatcgatgttttcccttaagaattagcagttcattcatagattctgtaaaatttggggatgtttcttaaactctagcttcttaatgtgttttttaatcattgggctaccccatttatacaggtattgc

SEQ ID NO: 131 - DNA, 1811 bp, Glycine max
  misc_feature (54)..(54): n is a, c, g, or t
  misc_feature (57)..(57): n is a, c, g, or t
  misc_feature (59)..(59): n is a, c, g, or t
  misc_feature (69)..(69): n is a, c, g, or t
  misc_feature (95)..(95): n is a, c, g, or t
  misc_feature (113)..(113): n is a, c, g, or t
  misc_feature (146)..(146): n is a, c, g, or t
  misc_feature (185)..(185): n is a, c, g, or t
  misc_feature (188)..(188): n is a, c, g, or t
  misc_feature (195)..(195): n is a, c, g, or t
  misc_feature (205)..(205): n is a, c, g, or t
  misc_feature (223)..(223): n is a, c, g, or t
  misc_feature (226)..(226): n is a, c, g, or t
  misc_feature (230)..(230): n is a, c, g, or t
  misc_feature (233)..(233): n is a, c, g, or t
  misc_feature (259)..(259): n is a, c, g, or t
  misc_feature (275)..(275): n is a, c, g, or t
  misc_feature (289)..(289): n is a, c, g, or t
  misc_feature (291)..(291): n is a, c, g, or t
  misc_feature (296)..(296): n is a, c, g, or t
  misc_feature (304)..(304): n is a, c, g, or t
  misc_feature (317)..(317): n is a, c, g, or t
  misc_feature (323)..(323): n is a, c, g, or t
  misc_feature (338)..(338): n is a, c, g, or t
  misc_feature (343)..(343): n is a, c, g, or t
  misc_feature (351)..(351): n is a, c, g, or t
  misc_feature (379)..(379): n is a, c, g, or t
  misc_feature (384)..(384): n is a, c, g, or t
ttttttttttttttttttcttttttttttttttttttttccacaaatgaggcanggntncccaccttgnttatcagttaaaacaaaacaaaacancaagcaatagttatcatnaatctggtaagtaaccaagtaggcacaggtttntgctacatgttattacaaagctgacaaaaaaaaacaagngcnttaaagngaccaatgancaaattcatatgccctgnacngttntanatccatataatgcctcctgccctgtngggacaggtccagctnaccatgaagttggntnttganaggctgtnaaatctgaccganacctanatcagggaccacctngggcnaacagttnccaaaatcaatgcccttgaaaaaccacnaggtntttggaagttgatggattgatgcaccatgagatgatgcagcaagttgtgtcaagggtgtcccgttgaaatttatcatgttactcaacccaagacttggtgctgtgtttctagaaccccatgtttgatttgacagaagagagagagcacagctcgtgtcggtgaccccaatgtaactttcccctggaggatgtcccgggccggcgaagcttgtcccacccaccgaaccttgcaagaaaaggtcagatgatgtctccgagttcccgtgccagctgagggtggaggtttgatttccaggcgctagctcggatgacctaggagttggaagtgaatttctcagactaagttttgggtatgaagccaattccatcagaaagttgccacctctgccactatgatcaaaagcagatgaagaaagtctagcatagcgagaggtcaagagggagctgggtgggggctttctccgacgttcattatggccagctagtcgcctgcggcaacttctttttccttgatcaaactcaggaagctgatgaaacctgtgcaaggctatgaaacatgatattagcttttacaaatataaatggttccaattttttatgtcaaagagaggtgaatgagtacaagcatacccaagtgccaagactagaaatactaacatgacaagtctactgtttccttagcatgccaagctgttgttgccacaaattggaagcacttaaacgcatctcttgtttgattaaatgcacatgcaaatgagacggaatttctaactgatttgattttgtcatcattgctaagattacagaacataagcaaatatgtataaacccaagaaaaagggtattccatatgatgtagtaataattctcacatcttgcagtaatgcacatcatgtgagcatctaacatgttcctttagccctgttttactgaagcaattctcaaacattgctcaagtaacatcctgtggctccattatacttagaattcagctttaacatattagtaaaataagaccaaaacaataccaataaagttctttatcttctctattaccaaaagggatagcattgtatttactctttagtgaaagacatcagaataattcaaaagagaagtcatcaagcttaaataaaggagataaactacaatgtgtatccatcggatagtacatctgaaatgcagggagattggatgctaagaaatccatcttaaatatctgtttactatctttctcataatatgtattttatcttagcatattcagaagagtattgtttttcatattaaggaaaagagtaacttttgccttagacaacagtggaagagccatgagataaaaagaagacacaaaatactcttggaacagtcaacagaaagccatcccagctccaaaaaaaaaagggggggggggcctacgtagctga

SEQ ID NO: 132 - DNA, 2249 bp, Glycine max
  misc_feature (403)..(403): n is a, c, g, or t
gcctccctctccctctctctctctgtcctcccctagtatcaagttcaactttcaatatattatccacacctcctgtctgcacaaatccacagtttcatcttcttaagtgccaaataaggtatgctttgtagggttccttctttaatattacatacaagcctctgtctttctgtccccccgttttctttctatttttaaaaacacaagagaggggagaaaaaatttggttcctttatttgactgtccagtggcaattttggtggtgaagggaagaacaacttaattgtaactccggtttccttggacctctttcaacttggctgctgttgttagtcattattacgtattttcaacactctctctggtgaagaaaggtgagcaaagaaagacaaagaggggctgnaaaagtgtaagtgttttggttattaatcgctttaatgtgtttttacttccataaatggttcaccttcttttttttctgagtgtgtagtccaatgtttctccccacttaaattttctcttttcaatatgcaattgatactatttgacatctatttgcttcattatattctgtagcaacttaattgtaactccgatttccttggaactctttcaacttggctgctgttgttagtcattattacgtattttcaacactctctggtgcagagggccatcttggtgtggtatacagaaaggtgagcaaagaaagactgaaaaagtgcaagtgtttatggattggaatttgaaagcaccttcttgggatttgagtgaagtggatcaggcaaacttacccaacatggaaacaatggaaggctcaagcagatatggaatgtatagaactaagggggaattttctgttgacttgaagcttggccaagtgggaaattctggcagggaatcatcagtgttgactaagtccaaagatggtggtgctgttggagtctccaaaatgatatcctcatcttcttcagggtcagctaagagagctcgttcccttagcaacgggacacaaacagtgtcatgccttgtggacgggtgccactctgatctcagtaactgcagagactatcataggcgccataaggtctgtgaagtccattccaagactgcacaggtcacaattggaggccagaaacaaaggttctgccagcagtgtagcaggttccattcactggaggaatttgatgaggggaaaaggagctgcaggaagcggttagatgggcacaaccgacggagaagaaagccacaaccagaagttgttctaacgcggtctgctagttttttgtcgaattaccaccaaggcacacaattgctatctttctcaagttcacatgtgtacccatccactactgtggtgaatcctactttgggtggagttgttacttctggtgatgtaaggcttcatgggcagaaccaccaccaccaccaaatgcatttggttgataaacaggacctgtttcttggatcttctccaaccggttacaaggaagggaagcatttggcattcatgcaaggtgaccacaccctcaacaaccagagcccacatcttccaggtgcttccgtgggcccggcccagatgtttcttaggaccagcccgtattcagaaagcggtggattgagatgcaaaatgttctgcgatagcctaacaggttcggcccacggcaacacctctcgtgctctctctcttctgtcatcaccaccacagccgcacagtcctggaaatggattaaaccaaatggtgaaccctcactcgccacttatgcaacccttgggcctgagcctgcatgataacagcctgggctccgtggacccggttttgggccccaacgggagtgaccattcctcatcaatgcatcacataggttctaatggatcccaggtgaatgaggcccctccactatttccctttcaatgggaatagacttcaattataaggactcgtcctttggttgttgattctttccctcgtactatttcaatgttcaatttatcttttaatgaaggcaatgaactatatccatcacgtttaacaaaatggtgtggaaatttttcatgtctttaaaagtgttgctgtgtactatcaaaaactatattcccgtcacctttttgtctttttttattctttgaagcagcaccacatttcaatgagaaactctacttgctcatacaatgacatgtgccagtgcgtaacttacaaaacgcacaaaaaaaattattgaagtaatggtcctgatcggacgcgtggg

SEQ ID NO: 133 - DNA, 1223 bp, Glycine max
tttttttttttttaatttaaccaataatataatgaagatagaaagtagaaacatgtaaagcttccaaactccggaaacgaatgatatgggatgcctttctaacagcctaaattttacaagttatttatttattataagcctgcaaggtaaatagtagtatgatgaagcatggagatgtgcgtaacaatagtaagaagctaaggtattaaaagttgttgccagtggagacatggtaggttggttatgtagaaactaaatgagcgcagtctggtacaaacaccattcgggaaatggagcgagttccatgcagttttagttaatctccatttaaaaataacatgcagactagaaatcttgttgtagtagaagcatagtgttgttaatccagttggttgcacggaaaacctgattcatagggtgagctcaagagctgaaagtcttgaaagcgattgctgctatcgcaatccgagaatgagatacacatgcttgaattttgttgatcagtgtgccaatactccgaggaaggaagtggtaaacgatgctgagtgattgagtgtgttgtccgagtggagtgttccagagaaagggacttggtctcatatggacaccatgatgaattcgttgacagaagagagagagcacggttaacatcttgtgtaccatttggaacttccatacctggaacaatactcttcgttgctatgcctctagatgttagaaggccactggaatcatcagaaagcatagagactatactcggtatcttattgaaggctttggcaggcttcgggaggaattcttttgtttgggggtgcttgctgctgtgcatatcttgccaagctaaatttgtagcagtccttgaaaatgcaaatgggctcattatttgcctcccatcatagggagatgaagacaaagctgatggatttaattggattgagtcaggctgagttttgcggcgccttgcattgtgatctgaaagtcgttgcctacagcttctttttttgtcatcaaactctgacagagcatggaacctgctacattgctggcaaaatcgacgttccaaaccagctataaccaccttaggggatttggaatgagcttcacaaactctgtgtttgcgatggtaatctttagcagatgagaggtcaaggccacagccttccacctggcagcttggatgctgtacagtctgagggggggggggccctacgtagctgactcga

SEQ ID NO: 134 - DNA, 1279 bp, Glycine max
aacaaaaccaaaaggataaatcttgatatttttgtttctatgtatgtcttcttttagtgagtgaagaaggagaaggaaaaaaactttaaatggattggaacttcaaactcagctccggttatttctctgaattcgaccaagaatctgtaccggatttaaccccagtcgatgcatcgatctcgttcggtaggtcatcctcatcaccaagaagattgcagccaaaagaagatttcccatttgatctgaaacttggaagaaacatcgtaaactcctcttcttcctccttctctgcttatggtaagacagagaaagtgataagtcttagtaagttgaaagagagcgcctctgaggcttcaagaagctccaagaggacaagagggaacaaccagatcccgaatttgctgggtgaaggaagggattccgaatttggcacccgtagagggttcctaaaagaactagggcctgggaaggcccttcaaaaatccccgggggtacaatcaatggcaataaacagaggttttgtcaacaatgcagcaggtttcatggtttggaagagtttgatgaaggtaagaaaagttgtaggaaacgtcttgatggacacaatcgaagaagacggaagcctcagcccgaccataccgatcgtactgcaactttcttccaaggtagcaaattgctggatttttctagctctccacacgtgtttccaactacatctgttgtgagtccgagctggggaaacggtcttgtaagcgtagctatgcccaatggttcaagttacgggcagaaccagagctatgctggctcctgtcctgcaaggacaggcattacgttcccgatatcttcttctccaaacagcagagggaaacagttccctttcttgcaagaagaagaagacagctcgagaatgacgagttgcatccatgactctgattgcgctctctctcttctgtcatcatcatcctctcatttgcttcagccacagccaccactttctttgtcccaagagaccgttttttatgggtccggattgtttgagaatgcgagtgcagtctctgatggatccggtaatgaggctgtacctcttccgcaaacgttccctccgtttcactggtagatagaatcagaaagatgtatgtctgcgtcgtctcgttctctattctcttctctttctctctagtttttcaaacttttgtaatttataagcagtacactgttgtagcatgacgcaagtttcaacaattatgtttaaagcagaactttactaaaaaaaaaaaaaaaa

SEQ ID NO: 135 - DNA, 1785 bp, Glycine max
attgttcaattggacttttacccattctttttttcacttggcatgttaatttaagtttggttaattccccttagtgtctcactatttatatatgtgcaatatttaatacaagctcatgccttggtcactgcttaattttttgttgctctccatgcaattgtgaaccatatggtataacacatagaaggactttgaagaagtagaagtggggagggggaagttgaattttgttattctttattttattttttttgttatggactggaatttgaaagcaccttcttgggatttggtggatcatgtggataaggcaacaaccttacaacaaaacataggaacaaaggcggcgccgtacgccccccccccctatagaatgaaaggggagttttctgttgacttgaagcttggtcatcatcatgtggggaattctggcactgaatcagcactagccaacaagtccaaagatgctgctgctgctagtggtgctgctgcttctgcaggagtttccaaaatggcatcttcaccttcagggtcttctaagagagctagaaccataagcagcacatcactcacagtgtcatgccttgttgatgggtgcaattcagatcttagcaattgtagagattaccataggcgccataaggtgtgtgaactccattccaagaccccagaggtcacaattggtggcttcaagcaaaggttctgccaacaatgtagcaggttccattcgctggagcaatttgatgaaagaaaaagaagctgcagaaaacgtttagatggacacaatagaaggagaagaaagccccagccagaacctctctcgcgacctggtagttttttgtcgaattaccaaggcacccaattgctacccttctcaagtccacacgtatatccttccactgccatggttagcccagcttggagtggtgcacttgtgacttcctctgcagatgctaggttgcacaaccacaaccaccaccaccaccaacaagacctttttctcggatcttctcacaaagaagggaagcaagtagcattcttacacaacaaccatccctccacagctgcagcactcagcagccaaaccccgccaccttttccatcctcttccgttcgccacacccttctcaggaccgaccctctatcagaaacttgcggcggagctagaagcaaaatgttctgtgaaagcttaacaacaacaacaactaacaataattcggtgcatgacactactccttgtgctctctctcttctgtcatcatcacagacgcacacaccagggaatggcttgaaccaaatggtgcagcctcctccctcaatgtccctcatgcagcccttaggcctgagcttgcaggataataacagcttagagtctgtggatcattgttcctccatgtatagcttggcttctgatcatggatcccagtgcaatgaagcagcccctcaactgtttccctttcaatgggaatagatattaattactttatctcaaggattattcaccactttgtttgttcattcctaatgaattctttccccccaaggactagttaattcattctgatttcaccctccctttataatgaaggcaatgcctatggacaatcatggtatttctatttgtatcttagggagagaaaaaaaagctcaacaattttacataagattcatactgggagttgtaagaggaaagtgtatatgtgtaatcctttagtgggaataacgttacgtgtaacccacaaaatttagtcaacattttataactttaaaaaaaaaaaaaaaaaa

SEQ ID NO: 136 - DNA, 1679 bp, Glycine max
cccggtcgaccctcagctacgtaggcccccccccccgacctacttttttactcgaacaagttctttctcctctcagagagaaacatcaaaatggggcttgcaccttctatgcccattttcttggaggctttatccgcagctatcagaatttaagagattcaagattagtacataactatgtgtgttaggtttaggtttggctttggcatcttaaaagggacataaagcaaaccatagttttgttggttggttatggattgggatgggaaagagtttgcttgggatccacgtgggttggagctggctaatggtgaaggccagaagagtgaagcagcttcagtggatttgaggcttggtgaggaaaaaacagccccagatgttgttgctaaggacacaaaagactcaaaaaccgtgtcatcgccatccgggtcgtcgaaaagatcccgccttcagaatggattacagaacatgtgttgttctgttgatggatgcaattctgatctcagtgattgcagagagtatcataggcgccatagggtctgcgaaaagcactccaaaaccccggttgtgatggtgggggggaaacaacagaggttctgccagcaatgcagcaggtttcattcgcttggggagtttgatgaggttaagaggagttgtaggaaacggcttgacgggcataacaggcgccggaggaaacctcagccaccctctcttttcatggctgctgagaagttcatgtacaattacaaaggacctagaatcctacactttggtagccctgaggcttatgccaaccctattatgagagacatgtggcctgctgctgccaaaactggagctgaatctggtcatgattctcctcgacttttatacagaattgacaagcataagcaagataagggacatcctctttggcaagaaaatgaccctaaagtaggcagtggtgatgaagcaatgccgggaactcccatttgtcagcctattcatggcaccatcgccccatcaatgggtggaaagagcaaccgaaagctctctacagatgcaaaacctggatcctttgactcaggttgtgctctctatcttctgtcaacacttcaatcacaaagtccagagttgagtatggtgcaatctagcatcacctgccctgtgcaatctccatcaggatctgtgcattttgatgctgtgaatgagtatgcatgctcagaaacggaaagagataagcctagtggtcaagtattggttttcgatgcaaaaacaaccaaccttcattacaacggaatgctgcaaatggatctcgatggatttgttgaaaatgaggacccactagcacttcctttcttgtgggagtaggtagctaactaagtggttatgtctttgttgggaaattatggattcaaaaccttgtgtgtgtactgtgtactccaatgattaaagcttaaacttgttgaagctttcaataagggtcctttgttgctgtcaatcttgttgtggtagcacaattgattatgctgcggaggatgaaatggattgtatgcgaactatgttctttcagttgtcatgagatcagtttgaacagttcagaagttattttctttgatgaaagatttttaatttccatgaaaaaaaaaaaaaaaaaatagataaaaaaaaaaaaactcgagacagtctctctctctctc

SEQ ID NO: 137 - DNA, 1611 bp, Glycine max
atgagacgaatgaagaaagatattgaagatgaggtgcttcccaatgatatgagtggggcacagttgaatgatgagagttatgaaggaagtgctggcattgttctgaagaaggggccatggacatcaactgaagatgatattttggtggattatgtcaagaagcatggggaggggaactggaatgctgttcagaagcacaccgggctgtttcgttgcggaaaaagttgtcggctgcggtgggccaatcacctaaggccaaatttaaagaaaggggcgtttgccgcagaagaggagcggctgattgctgaacttcatgccaaaatgggaaacaaatgggcacgcatggcagctcatttgcctggtcggacagataatgagataaagaactactggaacacccggatcaaaaggcgtcaacgggctgggttgccactttatcctccagaagtgagtttgcatgctttgcaagagagtcagcatagccaaagcactggtggacttaatggtggcgataaaatgcatcctgatttcttgcagaaaaacagttatgagatacatgatgctatatttgacagtctaaaggataatcagggaatcttaccttatgtgcatgagctttctgatatttctgtttatggcaataagctaaaaggtcttgattcttctcagtattgtagttttgtgccaccaacatcacctaagcgtaagcgtcttaaagagtcaacaataccatttattgattcctgtgctatgaaaaaaaaggatttatatccatttgatcaaattcaagacaataattctgataagattgcacaatcatttggaatgcaagcaccccttgatcctggtctctcctcgcacagttcaatgtgttacagccattcactttcaaatggcaactcctctacttctaagccttatgaggctatgaagttggagctcccttcactccaatatccagaactcgatttaggtagctggggttcatctcctccaccttctttgctcgagtcagttgatgatttccttcagtctcctacagcaattagtacactggagtcagattgttcttctccacaaaatagtggccttctggatgctttactttatcaggcaaagactatgagcagttcaaagaaccattgttctgataagagttcaaattcttctactgcaacccctggtgacagagctgacagctctattttgaatgtgtacgagacagaatgggaagattatgctgaccctgtatctccctttggtgccacttcaatattgaatgagtgcccagctcttagagccaatgcaaattcattgaacggacagctgccagttcagacctttactggcaaccttccgaaattagaatctgttgaccaggtttggactcctaacaatgaaaatctaaccttgtccctgttgaatattactcgtccagacttcttgcttgcttcagattggtatgacctaggttctggacattgcaagaaccaaaccatcacaactgatgctgcaacggcctttcttggagatgatttagccactgacctcaagcatatgactgctggaatttctaaaactatgtttgaaaatccattccagcccctctaa

SEQ ID NO: 138 - DNA, 1578 bp, Glycine max
atgagtcaaatgacaaatgaggtcgacaacaatgtgcattatgatgatcagactgggtcacagttaaatgatgatggtaatggagtaggtgttgttctgaagaaagggccatggacagctgctgaagatgctcttctggtgaactatgtccagaagcatggagaggggaactggaatgctgttcagaattactcaggcctgtctcgttgcggaaaaagctgtagactgcgatgggccaatcacctaaggccaaatttaaagaaaggagcatttaccgcagaagaggagcggatgattgctgaactccacgccaaaatgggaaacaaatgggcacgcatggcagcgcacttgcctggtcgtacagataatgaaataaaaaattactggaacacccggatgaagaggcggcgacgggctggcttgccactttatcctcctgaagtacttttgcaagcatttcaagagagaaagcatggccaaggtactggtgaaattagcgatggtgatggagggcatcgtgatttcttgaagaaaaacaattacgagatacatgatgcaatatttgacagtctgaaggaaaatcaaggaatcttaccttttttgcctgaccttcctgctatttctgctaatagctttcttccaaatggtcttggttctcctccatattgtaatttattgccatcaacattgccaaaccatgatcatcttcaagagtcaacaatgtcttttattggttccagtgaattgaacagcaatcgattttatccatttgaccatattaaggataatacttctgataagatttcagaatcatttggattgtattctccccttgatcgtggtgtctcacatggttcaatttgttacagccattcactatcgaatggcaattcctctacttctaagccgacttctgaggctgtgaagtcagagctcccttcactccaaattccagaaaccgaattcggtagttggggtacctctcccccacctccattgaacgagtctcttgatgttttcattcattctcctcaaccacctaatgcactagactcgggttcttcttcaccacttaatagtggcttgcttgatgcattactttatcaagcaaacactcttggttgttcaaagaataattcttctgacaagagttcaaattcttcaattgcaactcctggcgacagagctgagtgttctgctttgaacatgtacgagacagaatgggaggattatgctgaccctttatctccctttggagcaacttcaatcctgaatgagcatcctgttgttagcaccaatggaaactcatgggatgaatgggaactttttcagacctttagtggcaacaatgagagattgcagtcaattgaccaagtttggacccctaagagtgaaaatcaatccatgtctctgttgaatttcactctgccagatgtcttgataacttcagattggcacgagctgtattctgaccacgacagcacgaaccaagccatcatgactgaagctagtgatgatatcagtggacaaataacattgtacttgaaactttggacagcatgcagctcaatgcagtga

SEQ ID NO: 139 - DNA, 1554 bp, Glycine max
  misc_feature (1346)..(1346): n is a, c, g, or t
atgccagcagtgaactctaaggtttattacttccctcagggtcatgctgagcatgcatgtggaccagttaacttcaggacttgtcctaaggttccaccttttgttccatgtagagtgactgctgtcaaatacagggctgatcctgagaccgatgaagtctatgccaaactcaagctcattcctctgaatgccaatgatgttgattatgatcgtgatgttgttggtggggctgaaactcaggacaagcctgcttcatttgcaaaaaccttgacccaatctgatgccaacaatggtgggggattttctgttcctaggtattgtgcagagacaattttccctcgtttggactactcagttgaccctcccgttcaaaacatccttgccaaggatgttcatggagaaacatggaaattcagacacatttataggggcacgccaaggcgacatttgttgactactgggtggagtacttttgtgaatcacaagaagcttgttgctggggactcaattgtgtttttgagggcagaaaatggggatttgtgtgttgggattcgacgagcgaagaagggaatttgtggtggacttgagacttcctcagggtggaatcctgcaggaggaaattgtcatattccttatggtggattttcgcccttttttagggaggatgataatagaatctcgagaaatggcaatagcaatgggttaaaccctagtgtgagtatgatgggaaagggaaaagtcaggccagaagcagtttctgaagcttcaaatcttgcagccaataagaaacccttcgaggttgtttactaccctcgagcaagtactcccgagttttgtgtaaaggcctccctagttgaagcagcactacagattaggtggtgttctggaataaggttcaagatggcctttgaaacagaagactcctcacggataagttggtttatgggaactatatcttcggctcaggttgctgatccccttaactggcctaactcaccttggaggcttctccaggttacatgggatgaaccggatttacttcaaaacgtgagaagggtgagcccgtggctggttgaattggtgtcaaacatgcctgccattcatttttcccctttctcaccaccacggaagaaattgagattgcctcaacaaccagatttcccccttgatggccagattcctttgtcgacatttcccagcaaccttctaggtcctagtaacaccaaccaatttggttgtctacttgaaagtacacctgctggcatgcagggagccaggcatgctcattatggtctatccttatcggatctccacctcagtaaattgcagtcaggtctattttcgantggtttcccgtctcttgatcacgctgctacgccaatgagggtctcaaatagcataacattacaaaagcccaaccttagtgagaacgtctcttgcttactgactatggcaaattctacccagtcttcaaagaaattggatgttgggaagacaccttcgctcgtgctttttggccaaaaaattctcactgagcagcagatctctcccaag

SEQ ID NO: 140 - DNA, 1879 bp, Glycine max
aggttttcccaggtcatgatcgttgtaacagcgtctgccctagtgaattagtaatacgacctcccctataggggagaattggggtaccagggggccccccctcgggattttagtaatcagctgccccccccccccccccccgaaggtgagtggtgagtctgtgagagaagctgttactttggctgctagtaatcaaccttttgaggtagtttactatcctcgggctaatactccagagttttgtattaggacttctgctgtgagaggggctatgaggattcagtggtcctctgggatgaggttcaagatgccctttgagactgaggactcttccaggataagctggttcatggggactattgcttctgttcagcttcttgatcctatccgctggcctaattcaccctggaggcttcttcaggttacttgggatgagccagatttgctacataatgtgaagcgagtaagcccatggttggttgagttggtatcaaacgtgccaatcatccatctggcacccttctctccaccaaggaagaagcttaggtttccacaacacccagagtttccccttgactttcaatttccgataccatcattttcaggcaacccctttgggtctagcactagcagccccttgtgttgtctatctgataatgctcctgcaggcatacagggagccaggcatgctcaaattggaatatctttatcagatctccaccttaacaataagctgcagttggggttgcttccgactaacgtccaccagcttaatttgcacactgggatttgtaatggcaacatcaccaaccatggtaagagtaaagaaagtctatcatgcttgctgaccatgggaaattctaacaagagtttggagaaatctgatcatgtgaagagacaccaatttttgcttttcggtcaaccgatactcaccgagcaacaaatctctagatcttctagtgatgtgttgtctcaaaattttactgtgacggatgatgagaataaggagaagaaggagaagggatttcttagtgactcccagtcttcagtttcaccaggaaagtcatcttctaccgccgagttctcttggcaagttggttcggataccagtcattgcaaggttttcatagagtcagaggatgtgggacggacccttgacttgtcctgtcttggttcatatgaagagttgtacatgagactggctaacatgtttggaatagaaaggtctgatatgttgagtcatgttctctaccgtgactcagctggtgctcttaagcaaactggagaggaacccttcagtgagttcatgaagacagcaaaaagattgacaattctgacggattcaaacaacaaagatagtagaagggtttggatcacaggaattcgaaatgctgaacatggattggatgctgcatcaaataagacaggtcctctcagtatatttgcttaatatggtgtggcatgtcatggcatcggagatattgtttttagatatgaaatgttgaaggacacagttattactctgttgttagagatgctaatatgaactgaaaattcaatcaatattggcgtctttgttttcgatgcccatgtgtagaaaataatgatttttcctgtataatggacaattgctattctaatattaattattaattaacccagatttggttccccaaaaaaaaaaaaaaaaaaccgcagagcgaatttgctattcttttagttgttgtcgcgtctacacgtcactagttctggcaaattttgagtatagtgtggtgactgtgagcacacaggaaaactgtggtaatcagttcaagccatgctctgccatttattggcgtcatggatagtgtatttatgcgatgtggattaagttttgatt

SEQ ID NO: 141 - DNA, 1611 bp, Glycine max
attcggctcgagagatgttaaggaatggttgtggtgttggtgggaatttgagtggaagagtaaaagtgagggctgaggatgttgttgaagctgtgactcttgctgctagtaacaaggcttttgaggttgtgtattacccaagagccagtactcctgagttttgtgttaaggcttcttctgtgggggctgctatgaggattcagtggtgttccgggatgaggttcaagatggcctttgagactgaggatgctacaaggataagttggttcatgggaaccattgcttctgttcaggttgttgaccccatctgctggcctaattccccatggaggcttcttcaggttacttgggatgagccagatttactacaaaatgtgaagcgtgttagcccgtggctggttgaattggtatcaaacattccactcatcaattttacacccttctctccaccaagaaagaagcttcggccacaacacccagacttcccccttgatgttcaatttccaataccaatgctttcaggcaaccagcatgggcctaacagccccttgtgtggtttttcggataatgctcctgcagggatacagggagccaggcatgctcaatttggaaaatctctatcagatctccaccttaacaataataaactgcagttggggatgcttccaactaatatccatcaacttggaggagtgtatactgggatttcaagtggtaacatgatgaccaaacatgataagagcaaagaaagcttatcgtgctttctgaccatggggaaatctagtaagagtttggagaaatctgatgatgttaagaaacaccaatttttgcttttcggtcaaccaattctcactgagcaacaaatttctagctgttctagagatgtgttgtctcgcggaaaaagatcgctaggtgatgagaaggacaaagcgaaatgcgttttggatgactcgcaatctactctctcacagcagttttcaccaggaaaagcttcttctgctgagttcttttggcaacttggcttggatactggtcattgcaaagttttcttggaatcagaagatgtaggaaggaccctagacctatcgcagtttggttcttatgaagagctctataggagacttggcaacatgtttgggattgaaaggtctgagattttgaaccatgtgctctattatgatgcagctggtgctgttaagcaaactggagaagaacctttcagtgacttcatgaagacagcaaaaagattgacaattctgacagattcaggcagcaaaaatatcaaaagggcctttattacaggaactcgtaatggtgaacatggactagatccatcaaacaaaacaggccctctgagcatatttgcttaaaatatgctatagatagcatctgagacattgttgagatctgagtagttgaaggacagtcttaactctatttacctctgcaaagactgaacatgaactgaatcttttatcatggttgttacaattgtttactaaaaacaagtattttatcaaggttggcattgttggttattagtgtacaaataataatgatgctattatcatgatcaactaatattgtaatattaaccaagatttggacccc

SEQ ID NO: 142 - DNA, 2276 bp, Glycine max
ccacgcgtccgttaggcttgttcctttgaccagaaacgagggtgattttgaggatgatgctgttggaggcatcaatggatctgaaaataaagataaatccccttcttttgccaaaaccttgacacagtctgatgccaacaatggtgggggcttttctgttcccagatattgtgctgagacaatttttcctcggttggactattccgcggaccctcccgttcagaacatccttgccaaggatgttcatggtgagacatggaaatttaggcacatttataggggcacgccgcgccggcacttgttaactaccgggtggagtagctttgtgaatcacaagaagcttgtggcgggggattcaattgtgtttttgagggcagaaaaggatgatctgcgtgttggaattcggcgggctaagagggggattggaattggtggaggacctgaggctcctgcagggtggaattcaggtggggggattcgtcctatgccttatggagggttttcagcttttttgagagaggaagatagccagctcttgagaaatgggttgagtccaaatgcaaaggggaaagtgaggcctgaagcagttattgaggctgcaactcttgctgccaatatgcagccatttgaggttgtttactatccccgggcaagtgccccagagttttgtgtgaaggccaatttagttagagccgcattgcaggttaggtggtgtcctggaatgaggttcaagatgccctttgaaacagaggactcctcgcggataagctggtttatgggaaccatctcttctgttaactttgctgatccaagatggcccaactctccttggagacttctccaggttacatgggatgaaccagagttacttcaaaatgtaaaaagggtgagcccgtggctggttgaaattgtatcaaacatgcctaccattcatctttcccattactcaacacaacaaaagaagccaagattccctcaacacccggatttttcttttgatggtcagatttcattgccagcatttcccagcaactttctaggtccaagcaatccgtttggttgtctagctgaaagtactcctgctggcatacagggagccaggcatgctaattatggtatatccctatcaaatctccacttcaataaactgcagtcaggcctatttcaagctggtttccctccacttgatcacactgcttccccagtattgagagtctcctccaacaatgcagcaacaatgcaaaaggtcggcacgggtgacaacgtctcttgcttactgtccatgtcaactgctactcaaccttcaaagaaagtggatgatgtgaaggcaccccaattggtgctttttggccaaacaattctcaccgaacagcaaatttctttgaacacctctgctaagacagatcctactcgaaataattcatttgatggaaatgctgataaaatgtgcaagttttcagatggttttggttatgctcttcacccacaaggctcttctcttgagaggttacagtggtacaaggatcaacaaaaagaaaccatggctagtttggagacaggtcactgtaaagtttttatggaatctgaagacattggtcggactatggatctcacaatgcttggatcttatgatgaattgtatagaaagctggcagacatgtttggcatagaaaaatctgtggtgctaagtcacatgctttaccgtgatacaactggggcagtcaagcacattggagatgaagcattcagcgaatttaccaaaactgcaaggaggttgaccattctaatggattccaacagcgatggtagaggaatctagaggaagaaataaacaattatcatttcaattgtacagctggttgatcaatttctctggagagtctcatctaatttatggatattaatgtttttctcgaagggcctatttggatttgttttttttcttttagtgatgatagctcgtggttttccttctctttttggatcataacatggtttacttgaggcttttgtttaataattctgatgtgaaaaaaggtgggggagagaagagaaagggtagtgatcatatatccctatgaatacgattggttcataggagtttcctgtatacaatggtttttaagtgtaaaaaaagctacctaggcttaatggttattgagacagtagttacctatttttttgttctgtgtttttaccactgtagttacctatttcattttcttgtgactttcgtatgcaaaaggaaagaaggggaaaggggggggggggtaggt

SEQ ID NO: 143 - DNA, 735 bp, Glycine max
acgaggagcagttatggttctggagggcttgggcttgggccatacggggccttttcgggttttatgagggaggagagtgggagggcgaaggtgagtggtgaatcagtgagagaagcagttactttggcggctagtaaccaagcgtttgaggtggtttattatcctcgagcgaatactcctgagttttgtattaggacctcggctgtgagaggggctatgaggattcagtggtgttccggtatgaggttcaagatgccttttgagactgaggattcttccaggacgagctggttcatggggactattgcttctgttcaggttcttgatcctattcgctggcctaattcaccttggaggcttcttcaggtacacactatttcaattcatgcttgtctttgccaatattctaaagttcgaattttcatcgcaacaggttagttgggatgagcctgatttgctacataatgtgaagcgagtgagcccatggttggttgagttggtatctaacgtgccaatcatccatctggcagccttctctccaccaaggaagaagcttaggttcccccttgacgttcagtttccgataccatcgttttcaggcaacccctttgggtcttctagctctagcagccccttttgttgtctctctgataacgctcctgcaggcatacagggagccaggcattctcaaattggaatatctttatcagatctccaccttaacaataagctgca

SEQ ID NO: 144 - DNA, 1739 bp, Glycine max
ggattttctccctttttgagggaggatgataatagaatcttgagaaatggcaatagcaatggattgaaccctagtgtaagtatgatgggaaagggaaaagtgaggccagaagcaattattgaagctgcaaatcttgcagccaataagaaaccctttgaggttgtttactaccctcgggcaagtactcccgagttttgtgtgaaggcctcactagttgaagcagcaatgcagactaggtggtattctggaataaggttcaagatggcctttgaaacggaagactcctcgcgaataagttggtttatgggaactatatcttcggttcaggttgctgatcccctaaactggcctaactcaccttggaggcttctccaggttacatgggatgaaccagatttcccccttgatggccagattcctttgccgacacttcccaacaaccttctaggtcccaacaacaccaaccaatttggttgtctactcgaaagtactcctgctggcatgcagggagccaggcatgctcattatggtctatccttatcggatctccaccttagtaaattgcaatcaggtctatcttcggctggtttcccgcctcttgatcacgctgctacgccaatgaaggtctcaaataacaagacattgcaaaagcctagcatcagtgagaacgtctcttgcttactatctatgacaaattctactcggtcttcaaagaaattggatgctgggaagacaccttcgctcatgctttttggccaaaaaattctcactgagcaacagatctctccgagcagctctgttgatacactctccccagttcttaccagaaattgttcgacagatggaaatgtcaataaagtgactaatttttttgatggttttggatcagctcttcatcagcaaggtttacacgaacactcctcttgtgagaggttccagtggtgtaaggataatcaccaagaaattgaggccaatatggagactggccattgtaaagtttttatggagtccgaagatgtaggccgaactatggacctatcgttgcttcgatcttacgatgaattacatagaaagttggcagacatgtttggcatagaaaaatctgaaatgttaagtagggtgctttactgcgattcagttggggctatcaaacacattggtgatgagccattcagtgacttcacaagaacagccaaaaggttgactattctaatggattctggcagcaacaatgtaggagtgtagtggggcagaataaactattcttttaattgtacagatagttcacgaagtctcattttctaacctttccctcttcctggtgcaatggaaggagacaacctaatttattttttgaatatcaaactctacataaatgtttctattccatctcaaaggggatttttggatttttgaattttggttagagtgatcataacttgtgtttccctttttctttttgtttttttctgtcaactatctctttatctttgcctacttgagtttccttttaaaattttgttggggaaaaaggtggaggacaaagagagaagtttgaaatcctataaatatgattggtttgtaagcaggtaaaaatgtatttgatctgaatactagttgaaacaaaaggagagtcattcttgcttttatgtattcacttgttcaaagattgtaccattttcttcttgttgttgccttataaattatttgctattacaatttaatcttgcattgaatgc

SEQ ID NO: 145 - DNA, 1570 bp, Glycine max
ggttatctttccagggggtttttacaccagtcccacgggccgtttgtaaaataaggccgggcccagggggaaatggtaaatacggactccacctataggggcggaattggggattgggtaccgggccccccctcgagtcagctacgtaggccccccccccaattcatgcttgtctttgccaatattctaaagtttgaattttcatcgcaacaggttagttgggatgagcctgatttgctacataatgtgaagcgagtgagcccatggttggttgagttggtatctaacgtgccaatcatccatctggcagccttctctccaccaaggaagaagcttaggttcccccttgacgttcagtttccgataccatcgttttcaggcaacccctttgggtcttctagctctagcagccccttttgttgtctctctgataacgctcctgcaggcatacagggagccaggcattctcaaattggaatatctttatcagatctccaccttaacaataagctgcagttggggttgcttccaactaaagtccaccagcttaatttgcacgccgggatttctaatgctaagagtaaagaaagtctatcatccttgctctccatgggaaattctaacatgactttggagaaatctgatcatgtcaagagacaccattttttgcttttcggtcaaccgatactcaccgagcaacaaatctctagatcttctagtgatgtcgccacggatgatgagaataaggaaaagaagaagaagggatttcttagtgactcccagtcttcagtttcaccaggaaatttatcttctactgccgagttctcttggcaactcggttctgataccagtcattgcaaggttttcatggagtctgaagatgtaggacggacacttgacttgtcctgcctttcttcttatcaagagttgtacatgagactcgctaacatgtttggaatagagaggtctgatatgttgagtcatgttctctactgcgactcatccggtgctcttaagcaaattggagaggaacccttcagtgagttcatgaagacagcaaaaagattgaccattctgacggattcaaacaacaaagatagtagaaggtgggagaaagaaaattaatgaaatatgtataggatgtgcttccggggaagatactattgtatgtgcaagtgtaactgttccttcctctttgtgacttcaaagtctgttttgcagggtttggatcacaggaactcgaaatgctgaacatggattggatgctgcatcaaataagacaggtcctctcagtatatttgcttaatatggtgtggcatggcatcggagacattgtttttagatatgaaaagttgaaggacatagttattactcagttgtaagagatgctaatatgaactgaaaattccatcaatattggcgtctttgttttcgatgtccatttgtagaaaataatgatttttcctgtatgatggacaattactattctaatattaattaattaattaacctaaaaaaaaaaaaaaaaaaaaaataaaaaaaaaaaaaaaaaaagtctcctgcagcagaa

SEQ ID NO: 146 - DNA, 1154 bp, Glycine max
ggaccttggcgcatgcttcaggttaattgggatgaacctgaagtcttgcagaatgcaaagcgagtcagtccttggcaggttgaacttgtttcccttccatttgcacttcatacagtatactcccctaacaaaaggcttagatctgaccagggttctgggctgttaagtaatagggagggagaccccttctttcctatgacagggttccctaactcgacaatggaacacatgacagggttccctaactcgacagtgggacacatggataaatcattgttgagttatgatacttttcctgctggcatgcagggagccaggcatgatctattttctccatcaagtttttccaactttttaaatgataagtcctatctgtatatgggtagtggttcatttgggaacaatccagtgcaaagtttgggaactgtgacaacagagctaaacatgagcagttctcaatcggatgacttgtcaccacatagccagagtagttttcattcctttgccagagagtttgctgggacccggaactgtgacaccaaagttgcttctggttcaattctgctatttggtaagatcatacagcctgctgaaagtgatttgcatgatggtgattgcatggaacgtgatggcagcaggggcagcaataaacttaagacagttgaggcatgctatttttcaaagtagttatgcagcagaatgcagttaaatacttgtacaggaaatcaaggctggcaggtaaaacaggaagctgtctagggcttgtagtggtaaagtgatgtttccgggtcatcatatgttggtcttactacaaacttgaatgatgaactaacatcatgatatttgatcagttgtatgatattaatatctgacatattattgtgtatattttcaaatacattcttaaaaggcaattgtacttgccttttaaaaaaaatgcccatgcttgcgcaggtaacaacctccgtactcgtatatctttatttgatgaggtaattgtagcctgaaagaatgcttgcaatactctttaactctgtctagcatggttgctgcgtagcacatacttcatggtatgttgaggcagtatcatacctcactcatataatatttagcttgcatttatgtacgacgtcaatgaataacacgtctctgcc

SEQ ID NO: 147 - DNA, 3041 bp, Glycine max
attcggctcgaggaaaaaaacagaataggctctgtaactaacgtggtgaggccaggaagaaggaagtgtgtgtttgtttgttttactcaaaacgcgcgttcggagtcccgttcaacgcaatttctgttagaaaaagctttggtgttgaacgtcgtggtttgcttcaaagccaaaccaatctgtagcagctcaattatccctccacgatccgacgaaaaaagccgacacacactcataacttgtttttctggcttctcaagatacggcgtttactttttcagatccgacgaaaaaggcgagaacgaattcacaaggatcagttgtggagacagcaatttattgacaacaatttagagagatatttcaagtttgaattgatccgtcagcaaaattcgaaatcagaaactatgagcaactaggattctctttctctttcccagcggaaatataacctacaaccactctgtgaggttgctttgaattgttgtggatacatgtgatcaaatatatgatttttaatgtaagaaagaggctcataaaaatacaactaagtgaaagttgttgagtgagatgattacattcatggacacaagggagaatcaaagaggtggagagttgtttggatcctcagctatggcatgcatgtgcaggtggtattgtacaaatgccagcagtgaactctaaggtttattacttccctcagggtcatgctgagcatgcatgtggaccagttaacttcaggacttgtcctaaggttccaccttttgttccatgtagagtgactgctgtcaaatacagggctgatcctgagaccgatgaagtctatgccaaactcaagctcattcctctgaatgccaatgatgttgattatgatcgtgatgttgttggtggggctgaaactcaggacaagcctgcttcatttgcaaaaaccttgacccaatctgatgccaacaatggtgggggattttctgttcctaggtattgtgcagagacaattttccctcgtttggactactcagttgaccctcccgttcaaaacatccttgccaaggatgttcatggagaaacatggaaattcagacacatttataggggcacgccaaggcgacatttgttgactactgggtggagtacttttgtgaatcacaagaagcttgttgctggggactcaattgtgtttttgagggcagaaaatggggatttgtgtgttgggattcgacgagcgaagaagggaatttgtggtggacttgagacttcctcagggtggaatcctgcaggaggaaattgtcatattccttatggtggattttcgcccttttttagggaggatgataatagaatctcgagaaatggcaatagcaatgggttaaaccctagtgtgagtatgatgggaaagggaaaagtcaggccagaagcagtttctgaagcttcaaatcttgcagccaataagaaacccttcgaggttgtttactaccctcgagcaagtactcccgagttttgtgtaaaggcctccctagttgaagcagcactacagattaggtggtgttctggaataaggttcaagatggcctttgaaacagaagactcctcacggataagttggtttatgggaactatatcttcggctcaggttgctgatccccttaactggcctaactcaccttggaggcttctccaggttacatgggatgaaccggatttacttcaaaacgtgagaagggtgagcccgtggctggttgaattggtgtcaaacatgcctgccattcatttttcccctttctcaccaccacggaagaaattgagattgcctcagcacccagatttcccccttgatggccagattcctttgccgacatttcccagcaaccttctaggtcctagtaacaccaaccaatttggttgtctacttgaaagtactcctgctggcatgcagggagccaggcatgctcattatggtctatccttatcggatctccacctcagtaaattgcagtcaggtctatcttcgactggtttcccgcctcttgatcacgctgctacgccaatgaaggtctcaaataacaagacattgcaaaagcctagcatcagtgagaacgtctcttgcttactatctatgacaaattctactcggtcttcaaagaaattggatgctgggaagacaccttcgctcatgctttttggccaaaaaattctcactgagcagcagatctctccaagtagctctggtgatacactctccccagttcttaccagaaattgttcatcagatggaaatgtcgataaagtgactaatttttctgatggttctggatcagctcttcatcaggaaggtttacgcgaacactccttcttgtgagaggttccaatggtgtaaggataaccaccaagaaactgaggctggtttggagattggtcactgtaaagtttttatggagtctgaagatgtgggtcggactatggacctctcgttgcttcggtcttatgatgaattacatagaaagttggcagacatgtttggcatagaaaaatctgaaatgttaagtcacgtgctctatcgtgattcaactggggctgtcaaacgcattagtgatgaatcattcagtgacttcacaagaacagccaaaaggttgactattctaatggattctggcagtaacaacgtaggagtgtagtgaggcaaaataaactattcttttaattgtataaatggttcatgaagtctcattttctaacctttccccctcctggtgcaatggaaggaggcagcctgatttagtttttgaatatcaaactctacataaatgtttctattccatctcaaaggggatgtttggatttttgaattttggttagagtgatcataatttgtgttttcattttttttttgtcactatctctttatttttgcctacttgagttttcttttcaaattttgttggggaaaaaggtggaggataaagagagaagtttgagatcctataaatatgattggtttgtatgcagtaaaaaaatatacagtattcaatctaaatattagtgaa

SEQ ID NO: 148 - DNA, 2632 bp, Glycine max
ccacgcgtccgcctttctttcactcacagagatctaaaagcacaaaaaacaaaaaccagctcgtgcttgtactttgcgcgatgaatctcctttgaagaaaacagaaacttcaaaaagcacattattttctcttttgaacacactctgttttttttgttgtttccatgaaggaaggtgaaaaggtattggatccgcagctatggcacgcgtgtgcaggtggcatggttcagatgccgcaaatgaactccaaagtcttctacttcccacagggtcacgccgaacacgcccacaccaacattcatctgaggcttccaccattcattttatgcaacgttgaagcagttaagttcatggcgaacccagaaaccgacgaagtgttcgcgaagctgagtttgcttcctctcagaaactcggaactcggtgctgactcggacggtgctggtggtgatgacgtggcagaaccttcttgttgtgaaaagcctgcgtctttcgctaagactctgactcagagcgacgccaacaatggtggggggttttcggttccgcggtactgcgcggagacaattttcccgcgtctggactacacggcggagccgccggtgcagacggtggtggcgaaagacgtgcacggcgagacctggaggttccggcacatctaccgagggacgccacgtaggcacttgctgaccacagggtggagcagtttcgtgaaccagaagaaactcgtggctggggattccgttgtgtttctgagggctgagaatggtgatttgtgtgttgggattcggagggcaaaaaagggaattagcgagggttcaggttcaggttcatcatctgtgtggagttcagcttctgggtctggaaatggaaattgtgggattgggccttatgggcctttttcttttttcttgaaagaagaaaacaaaatgttaaggaatggttgtgtgttggtgggaatttgagtggaagggtgaaagtgagggctgaggatgttgttgaagctgtgactcttgctgctagtaataagccttttgaggttgtgtattacccaagagctagtactcctgagttttgtgttaaggcttctgctgtgagggctgctatgaggattcagtggtgttctgggatgaggttcaagatggcctttgagactgaggatgcttcaaggataagttggttcatgggaaccattgcttctgttcaggttgttgaccccatccgctggcctaattccccttggaggcttcttcaggttacttgggatgagccagatttactacaaaatgtgaagcgtgttagcccgtggcttgttgagttggtatctaacattccactcattaatttcacacccttctctccaccaagaaagaagctgcggccacaacacccagacttcccccttgatgttcaatttccaataccaatgttttcaggcaaccagcttgggcctaacagccccttgtgtggtttttcggataatgctcctgcagggatacagggagccaggcatgctcaatttggaaaatctctatcagatctccaccttaacaataaactgcagttggggatgcttccaactaatatccatcaacttggagtgtataatgagatttcaaatggtaacatgatgaccaaccatgataagagcaaagaaagtttatcatgctttctgaccatggggaaatctaccaagagtttggagaaatctgatgatgttaagaaacaccagtttttgctttttggtcaaccaattctcactgagcaacaaatttctagctgttctggagatgtgttgtctcaccgaaaaagatcggtaagtgatgataaggacaaagcgaagtgccttatggatgactcgcaatctacactctcacagcagttttcaccaggaaaagcatcttctgctgagttctcttggcaacttggcttggatactggtcattgcaaagttttcttggagtcggaagatgtaggaaggaccctagacctatcgctgtttggttcttatgaagatctgtataggagacttgccatcatgtttgggattgaaaggtctgagattttgaaccatgtgctctaccatgatgcagctggtgctgctaagaaaaccggagaagaacccttcagtgacttcatgaagacagcaaaaagattgacaattctgacggattcaagcagcaaaaacattaaaagggcctttattacaggaactcgtaatggtgaacatggactagatgcatcaaacaaaacaggccctctgagcatatttgcttaaaatatgctatagatagcatctgagacattgttgagatctgagtagttgaaggacagtcctaactctatttacctctgcaaagactgaacatgagctgaatcttttatcatggttgttactattgtgtactaaaaacaatatctatcaaggttggcttagttgtttattagtgtacaaataatgatgccattatcatggtcaactgttattgtaatattaaccaagatttggaccccatttggcaacttgcttcttttcttttccttatttttttgttcattgtgctctcacactcacatgctgctgcctacgtgtctccacgtcaccagtgctcaataaattgtgcaaagttggtat

SEQ ID NO: 149 - DNA, 1094 bp, Glycine max
cggacgcgtgggcagccctagaatgttcctgttccagaaggcttccgcttctcatgtccagcttctgattgggtcaaagaagtactttcagttccatcttccccgtgacgcagttaacattgccgaggcctcagacgcaaccatagccaaactagtcctggaatcagacccacgcaccctctccgaagccctaaccaagcccagaatccactggaccccagagctagtaaacaaaacccttaagcgcctctggaaccacgggcccaaggccctcctattcttcaaacacctcgaccgccacctcccttcctacacccactccccctcctccttcgaccacgccgtcgacatcgcggcccgcatgcgcgacttcaactccgcctgggccctcgtgggccgcatgcgctccctccgcctcggcccgtctcccaaaaccctcgctatcctcgccgtccgctacgcctccatcggcaagccccaccgcgccgtccgcaccttcctctccatgcacgagcacggcctccaccaagatctccactccttcaacaccctccttgacatcctctgcaaatcgaaccgcgtcgaaaccgctcacgacctcctcagaactctcaaatctaggttcagacccgacaccgttagttacaacattctcgcgaacggttattgcttgaaaaaacgcacgccgatggcgctgcgggttttgaaggagatggtacagcgtgggattgagcctacgatggtcacgtataacaccatgctgaaggggtattttaggagtaatcagattaaggaggcttgggagttttacttggagatgaagaagaggaagtgtgagattgatgttgtgtcttacaccactgtgattcacgggtttggagaggcgggtgaggttaagaaagcaaaaagggtttttgatgagatggtgaaggagggtgtggctcctaatgttgctacttacaatgctttgattcaggttttttgtaagaaggatagtgtgcagaacgcagtgggcggttttgaggagatggtgagggaggggggtggtgttccccgaagtggttactttcaatgttggtataccaggtttgggg

SEQ ID NO: 150 - DNA, 706 bp, Glycine max
  misc_feature (689)..(689): n is a, c, g, or t
ctctttctaaacatttggatttcaaagggattacatccgaccttgttactctgaacatcctcatcaactgtttctgccatctgggtcagatcactctttccttttctgtattggccacgattctcaaacggggttatcacccagatgtaataaccctcaccacactcatcaaaggcctctgtcttcgtggggaggttaagaaagcactgaaatttcacgatgatgtcgttgccctagaattccagttagaccgaattagttatgggacattaatcaatggtttgtgtaaaataggagaaacaaaggctgccatacagttgatgaggaatctggaagaacgctccattaagcctgatgtggtaatgtacaatataataattgatagcttatgcaagaataaacttgtaggggaagcttgtaatttgtactctgaaatgaatgcgaaacaaatttatcctaatgttgtcacctacacgactctgatctatggcttttgcatcatgggttgtttgaagaagcggttgctttgttaaatgaaatgaaattgaaaaacatcaacccagatgtctatacctttagcatattgattgatgcattaggtaaggaaggaaagatgaaagcagcttaaatagtgttggcttgtatgatgaaagcatatgtaaaaccctgatgttgtcacttacaacagntctagtggatggatact

SEQ ID NO: 151 - DNA, 1093 bp, Glycine max
  misc_feature (201)..(201): n is a, c, g, or t
  misc_feature (233)..(237): n is a, c, g, or t
  misc_feature (239)..(253): n is a, c, g, or t
gtcaaaatgcggcaaagtggactatgcacatcaagcatttttggcaatagataaacctgatactgttgcatggactgcaataatatgtgctcatgcttaccatggcaaagcttctgaagctttaaggctttttaaagagatgcaggggtctggtgtaaggccaaatgtggtcactttcataggtttgttaaatgcttgcgntcattcaggtttagttaaagagggagagcagnnnnngnnnnnnnnnnnnnnnaaatatggtgtgaacccaacaattgatcattacaattgcatgattgatatatactctcgtgctggactgctgcaggaggctcttgaggtgataaggagtctgccatttgaacctgatgttatgagttggaagagtttattaggaggatgttggagccatcggaatcttgagattgggatgattgctgctgacaacatctttcgcctggacccactagactctgctacttatgtgatcatgttcaacttgtatgctttggctgggaagtgggatgaagcagcacaatttagaaagatgatggctgaaaggaacttgaggaaggaagtcagttgcagctggattattgtgaagggtaaagtccaccgttttgtggtaggtgatagacaccaccctcaaacagaacaaatatactcaaaattaaaagaactcaatgtttctttcaaaaagggtgaggagcgccttctcaatgaagaaaatgctctatgtgactttactgaacgaaaagatcaacttcttgatcatagtgaaagactagctatagcctatggtctcatatgcactgcagctgatacccccattatggtattcaaaaatacacgatcatgcaaagactgccatgaatttgcaaaaagagtctcagtagtaactggtcgtgaattagttgtgagagatggcaacaggtttcatcatattaattcaggggaatgttcttgccgtgattattggtgatcttaacttcgttcttttcaaggcctcagcagcttggttttcttaatgctgcctcagttacagtgttgaatgatctataattctatatatatacacaattggatatgcaga

SEQ ID NO: 152 - DNA, 1320 bp, Glycine max
gaattcggctcgagttctcacttgaactttgaacttcttttttctctattatcatctttctttttttcttcatctcttatatttcacctttattacctttatcgaaggaaaaatgagcaacataagcatggtagaggcaaagctgccaccagggttcaggtttcatccaagagatgaagaacttgtgtgtgattacttgatgaagaaggtggcacacaatgattcccttctcatgataaacgttgaccttaacaagtgtgagccatgggatattcctgaaacagcttgtgtgggagggaaggagtggtatttctatacacaaagagaccgtaagtatgcaacagggctacgcacaaatcgtgccactgcttcagggtattggaaggccacagggaaggacaggtctatcctccgcaagggcacccttgtagggatgaggaagactttggtgttctatcaagggagggcacccaaaggaaataaaactgagtgggtcatgcatgagtttcgaattgaaggacctcatggacctccaaaaatttcttcttccaaggaagattgggttttgtgtagggtgttctacaaaaacagagaagtttcagccaaacctagaatgggtagctgctatgaggacacaggatcttcatctcttcctgcattaatggactcttacataagttttgaccaaactcaaacccatgcagatgagtttgagcaagtgccctgcttctccattttctctcagaaccaaacaagccccattttcaaccacatggccactatggagcctaagttacctgccaaccatgcaactaatgcatatggaggagcaccaaatttgggttattgcttagaccctttatcatgtgacagaaaaatgttaaaagctgttttgaatcagatcacaaagatggaaaggaatccacttaaccaaagcctaaaagggtcaccaagcttaggagaaggaagttcagagagttacttatctgaagtggggatgccccacatgtggaacaattactgatgtgggacttcagtccttaaaccctcttcccctgtgccaccatgggaaaaaaaatgaagaaaaaaacctagaaaaaaatgcttaagggggaagataaaatcaatccattgttttaagtcatggtgaatatttatgttttacttgtggtgttttagctattaatgtatacccatccatgatgtgtcccaatatattaggaaaatgggacttgtaatcgaaacttataaatatttgtagttaattttagttagtggatgatttttttttcaaaaaaaaaaaaaaaaagggcggccgcc

SEQ ID NO: 153 - DNA, 1323 bp, Glycine max
cgattaaaccccattacacctcacaaaatttctcacttcaactttgaacttcttttctctattattattatctttctctttttcttcatctcttatcttccttcacctttttattgaaagaaaaaaaaaatgagcaacataagcatggtagaggcaaagctgccaccaggattcaggtttcatccaagagatgaagagcttgtgtgtgattacttgatgaagaaggtgcaacacaatgattcccttctcttgatagatgttgaccttaacaagtgtgagccatgggatattcctgaaacagcatgcgttggagggaaggagtggtatttctacacacaaagagaccgtaagtatgcaacagggttacgcacaaatcgtgccactgcctcagggtattggaaggccacagggaaggacaggcctatcctccgcaagggcacccatgtagggatgaggaagactttggtgttctatcaaggaagggcacccaaagggagaaaaactgagtgggtcatgcatgagtttcgtatcgaaggacctcatggacctcctaaaatttcttcttccaaggaagattgggttttgtgtagggtgttctacaaaaacagtgaagttttagccaaacctagcatgggtagctgctatgaggacacgggatcttcaactcttcctgcgttaatggactcttacataagttttgaccaaactcaaacccatgcagatgagtttgagcaagtgccctgcttctccattttctctcagaaccaaacaaaccccattttcaaccacatgaccactatggagcctaagttccctctcaaccatgcaactacaacatatggaggagcaccaaatttgggttattgcttagaccctttatcttgtgacagaaaaatgttaaaagctgttttgaatcaaatcacaaagatggaaaggaatccacttaaccaaagtctaaaagggtcaccaagcttaggagaaggaagttcagagagttatttatctgaagtggggatgccccacgtgtggaattactgatgtgagactttagtacttaaaccctctcctccacctatgccaccatgaaatttttttttttaaaaaaaaaacaagaaaaaaaaaggtataagggggaagataaaatcaatccattgttttaagtcatggtgagtacttatgttttacctgtggtgttttagctattaatgtatacccatccatgatgtgtccctatatattaggaaaatgggacttgtaatttaaacttataaatatttgtagttaattttatttagtggatgatttttttttcttctttgttaa

SEQ ID NO: 154 - DNA, 912 bp, Glycine max
atgagcaacataagcatggtagaggcaaagctgccaccagggttcaggtttcatccaagagatgaagaacttgtgtgtgattacttgatgaagaaggtggcacacaatgattcccttctcatgataaacgttgaccttaacaagtgtgagccatgggatattcctgaaacagcttgtgtgggagggaaggagtggtatttctatacacaaagagaccgtaagtatgcaacagggctacgcacaaatcgtgccactgcttcagggtattggaaggccacagggaaggacaggtctatcctccgcaagggcacccttgtagggatgaggaagactttggtgttctatcaagggagggcacccaaaggaaataaaactgagtgggtcatgcatgagtttcgaattgaaggacctcatggacctccaaaaatttcttcttccaaggaagattgggttttgtgtagggtgttctacaaaaacagagaagtttcagccaaacctagaatgggtagctgctatgaggacacaggatcttcatctcttcctgcattaatggactcttacataagttttgaccaaactcaaacccatgcagatgagtttgagcaagtgccctgcttctccattttctctcagaaccaaacaagccccattttcaaccacatggccactatggagcctaagttacctgccaaccatgcaactaatgcatatggaggagcaccaaatttgggttattgcttagaccctttatcatgtgacagaaaaatgttaaaagctgttttgaatcagatcacaaagatggaaaggaatccacttaaccaaagcctaaaagggtcaccaagcttaggagaaggaagttcagagagttacttatctgaagtggggatgccccacatgtggaacaattactga

SEQ ID NO: 155 - DNA, 962 bp, Glycine max
  misc_feature (876)..(876): n is a, c, g, or t
cgccttgaaggcaaatttgcttaccactacctttctcgcaactccaaagatgagtgggtcatatcacgtgtgtttcagaagagtaacaccgccaccaacaatggaggctccgtcatgtctgcttctagtaactccaagaagacaagaatgaacagcaccacctctcttatccatgaaccaagttcaccctcagttttccttccacctcttctagacacttcaccctacaccatcacagctaacttcaccgaccgtcacaatggttcctatgacagcatcaccaaaaaggagcacgtgtcctgtttctccacaatagctgcagcaacaactgctgttgtctcccccaacaacttcaacaatgcaggctttgacctttcaccttctcagcctcttgcaaccgacccatttgccaggtttcagaggaacgttgatttttctgcttttccaagtttgaggtcactacaagacaaccttcagttccctttcgtcttttccacggctgcaccgcccttctccggcggcggttccggcgactttctcagttggccggtgccggaggagcagaggctgatagatggtgtttccaacatgccactgggagtgtcggagcttgattgcatgtggagctactaattcagcttttgttgattttgtccagagttgactacttggattagacttttagactttgattatgtcacattttgttatgtgttatgtgttatgttttctttattgcctaatgtggcttgtactatagtactagtacttggtttgtgtgctgctgttgattatgtgtgatgttttccttaatggccttgtatgagggttgaacaatctacttcggttgttttttgttttttattactagccgtntagggttagtttgatgtaaggttagttttggtattgtgtttgagctatggtacacttagaatttatgtccaaaaaaaaaaaaaaaa

SEQ ID NO: 156 - DNA, 1363 bp, Glycine max
gaattcggctcgagcggctcgagctcttctaaaacttaccaacacaacaaaatcgagtttccaataaagagttttgttgaaatggaaaacgttccggcggtgtgtaaggaagatgatcagatggatttgcctcccggatttcgattccacccgacggatgaagagctcataagccattacctctacaagaaggtcattgacaccaagttctgcgccagggcaattggagaagtggacctcaacaagtccgagccttgggatttgccatggaaagccaaaatgggagaaaaagagtggtactttttctgtgtgagagacagaaaataccccactggcttgagaaccaacagggccacagaagctgggtactggaaggccacagggaaagacaaagagattttcagaggaaaatctttggttggaatgaagaaaactctggttttctacagaggtcgagcacccaaaggagagaaaagcaattgggtcatgcacgagtaccgactcgagggaaaattctctgctcacaacctcccaaaaactgcaaagaacgagtgggtgatttgcagggtgtttcagaagagttcagctgggaagaaaactcatatctcggggataatgaggttggactcttttgctaatgaattgggttcttctgctctgccacccctttcagattcttcgccttctattggcaacactaaacctctgaatgattcggcttacgtgccctgcttctccaatccaattgatgttcaaagaaaccaagaaggtgtcttcgattccttcaccaactctatgtatggggtttcttcaaatcctatggacattcttcccagaatgccaccttctggctccttctactccactcaaggtgttcaagctgcgcctaattttgcatttcctggttctgtttacactcttcaggaccacaccatcctgagagctttgtgtgaaaacaatggttacaagccagagagggacatgatcagtgtttcgcaggaaacgggtctaactactgacatcaacgctgaaacctcttcaaattttgatgtgggttggaggccctttgagaatcacaatcatgcatctgtttctgttgccccattggatcttgatggtttgtggaattactaaaagtttaaataaaaggaacaattacagtgaaaagtgaaattaaccccacttttgagctgaaaggaagaggaacaacaagagcctcgggtggggttgatactgttgttgtttctctgaatagattttatctaagacatgtaattactgaagcatatgttgttaagtgtaagaattaagaaatgttgtgaaaaaaaaaaaaaaaaaaaaaaaaaaaaaagggcggccgccg

SEQ ID NO: 157 - DNA, 1598 bp, Glycine max
aaacagcagtatttatggccttgttttcctctctctctattctcctcatcatattcacatctccatctacacttccttcatttccatccccttctctcttttaaacctcacgcacaacgaaatcgtgattctgttgttcttttgaaatggaaaacgctccggtggtgtgtaaggaagatgatcagatggatttgcctcccggatttcggttccacccgactgatgaagagcttataagccattacctctacaagaaggtcattgacaccaagttctgcgccagggctattggagaagtggacctcaacaagtctgagccttgggatttgccatggaaagccaaaatgggagaaaaggagtggtactttttctgtgtgagagacagaaaataccccactggcttgagaaccaacagggccaccgaagctgggtactggaaggccacaggaaaagacaaagagattttcagaggaaaatctttggttggaatgaagaaaactcttgttttctacagaggtcgagcacctaaaggtgaaaaaagcaattgggtcatgcacgagtacagactcgaggggaaattctctgttcacaacctcccaaaaactgcaaagaacgagtgggtgatttgcagggtgtttcagaagagttcagctgggaagaaaactcatatctcggggataatgaggttggactcttttgctgatgaattgggttcttctgctctgccacctctctcggattcttcgccttctatcggtaacactaaacctcttaatgatacggcttacgtgccctgcttctccaatccaattgatgttcaaagaaaccaagaaggtgtctttgattccttcaccaactctatctatgcggtttcttcaaatcctatgggcattcttcccagaatgccaccttctggctccttctactccactcaaggtgttcaagctgcgcctaatttggcatttcctggttctgtttacacccttcaggatcacaccatcctgagaaccttatgtgaaaacaatggttacaagccagagagggacatgatcagtgtttcgcaggaaacgggtctaactactgatatcaacgctgaaacctcttcaaattttgatatgggtaggaggccctttgagaatcacaatcatgcatctgtttctgttgccccattggatcttgatggtttgtggaattactaaaagtttaaataaaaggatcaattacagtgaatagtgaaattaaccccacttttgagctagaaggaagaggaaaaagaagagcctcggatgggattgatgctattgttgtttaatttctctgtatagattttatctaagacatgcatgtactgaagcatatgttgttaagtgtaagaaatgttgtggaatgaattaggctggtttggtctgttgacactttaggcttgtgcgtggctggcatgagcatgagcatgagcatgagcatgattaatttgtttcagtttggattaaaaataatagtagaatgggactggtggattaaaattagaaaaaaaaaaaaaaaaaaaaaaaaaaaaaaaaaaaaaaaaaaaaaaaaaaaaaaaaaaaaagggcggccgc

SEQ ID NO: 158 - DNA, 1834 bp, Glycine max
ggctcgagcacaattttcagttccatgtcttcccatgattttcaccctttttctctctctcactttctgtggacttttctgtggtttccttttcagtgaaataaaaaaaaaaccactctggcttattactgtctatatagattcttctgaatccagttctttctaaaccaaaccaaaaaaacattccctctccaaccaagttttgtttttttttttttttcatgtgaaaattgaaatcgcaaccgcaatttaaaaccttggtgtatgttcttatattgaaattgaaattcttggctagggaagcaaaagggtagtaattggttttagagtaagtgagaatggaaaacgtttcggttcttttgtgtaataaggaaaaggatcagatggatttgcctcctgggtttaggtttcacccaacagatgaagagcttattagtcattacctttacagaaaggtcactgacaccaacttctcagctagagccattggagaggtggacttgaacaggtctgagccttgggatttgccatggaaggccaaaatgggagagaaagagtggtactttttctgtgtgagggacagaaaatacccaactggtttgaggactaatagagccactgaatcaggatactggaaggctacagggaaagacaaagagattttcagagggaaatctcttgtgggtatgaagaaaactttggttttctacaaaggaagggctcccaagggagagaaaactgattgggtcatgcatgagtataggcttgatggtaaattctcttttcacaacctccccaaaactgcaaaggtaataataataataactaataacaactttgattttggcttgatcatgttgcttcctatgttccactttttattctcttattagtattagtactttgtttgctttgtttgattttcagtgctgtgtttattattgtgttgcagaatgagtgggtgatttgcagggtttttcagaagagttcaggtgtgaaaaggactcatatttctgggatgatgatgttggactcttatggaaacgaaatggtttattcttcttctgctttgccacctctcactgattcctcaccttccattggcaacaacaccaaagcactgagtgtgactgattctgcttacgtgccctgcttctccaatccaattgatgttcctagaggaatctttgattccttgaacaacatcaatatcagcatcaacagcaacaccctttatggagtttcttcaaaccattcattttacaatactcagggggttcaacttcaggctccaccaactttgccattacctagttcttcaaaccattaccttagagcctttcttgaaaaccaaggaaatggatcgaacatgagcaacaatggttttgagccagagagggaaatggtcagtgtctcacagaaaacaagtctttctactgatgtgaaggctgaaatctcttcattgggtaaaaggcactttgagaatcaaaacaacccaattgcttcagcagctgcagttgcaccaatggaccttgctaccttgtggaactactgatctcaaataaagaattgccattggaaaaaaaaaaaaaaaaggccaactttttcagctgaaaaagtatagcctcataatttaccatatttactgtctggttttgatttttatgttgtccttcttgttgttattgttgtttgtttgtttgtctgtatagattttaactaaaagatttgctgaataatagtgaagcatgtattttgtactgttaagtgttaagttatgctgttttggtccaaaaaaaaaaaaaaaaaaaaaaaaaaaaaaaaaaaaaaaagg

SEQ ID NO: 159 - DNA, 1280 bp, Glycine max
cgggtgaaaattgaaatcgcaaccgcaatttaaaaccttggtgtatgttcttatattgaaattgaaattcttggctagggaagcaaaagggtagtaattggttttagagtaagtgagaatggaaaacgtttcggttcttttgtgtaataaggaaaaggatcagatggatttgcctcctgggtttaggtttcacccaacagatgaagagcttattagtcattacctttacagaaaggtcactgacaccaacttctcagctagagccattggagaggtggacttgaacaggtctgagccttgggatttgccatggaaggccaaaatgggagagaaagagtggtactttttctgtgtgagggacagaaaatacccaactggtttgaggactaatagagccactgaatcaggatactggaaggctacagggaaagacaaagagattttcagagggaaatctcttgtgggtatgaagaaaactttggttttctacaaaggaagggctcccaagggagagaaaactgattgggtcatgcatgagtataggcttgatggtaaattctcttttcacaacctccccaaaactgcaaagaatgagtgggtgatttgcagggtttttcagaagagttcaggtgtgaaaaggactcatatttctgggatgatgatgttggactcttatggaaacgaaatggtttattcttcttctgctttgccacctctcactgattcctcaccttccattggcaacaacaccaaagcactgagtgtgactgattctgcttacgtgccctgcttctccaatccaattgatgttcctagaggaatctttgattccttgaacaacatcaatatcagcatcaacagcaacaccctttatggagtttcttcaaaccattcattttacaatactcagggggttcaacttcaggctccaccaactttgccattacctagttcttcaaaccattaccttagagcctttcttgaaaaccaaggaaatggatcgaacatgagcaacaatggttttgagccagagagggaaatggtcagtgtctcacagaaaacaagtctttctactgatgtgaaggctgaaatctcttcattgggtaaaaggcactttgagaatcaaaacaacccaattgcttcagcagctgcagttgcaccaatggaccttgctaccttgtggaactactgatctcaaataaagaattgccattggaaaaaaaaaaaaaaaaggccaactttttcagctgaaaaagtatagcctcataatttaccatatt

SEQ ID NO: 160 - DNA, 2385 bp, Glycine max
atgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctccaagctgtcaataggaagctgactgctatgaacaagctgctgatggaagagaatgataggttgcagaagcagactaagcagcagccaaccaaagacacaagctgtgaatcagctgtgacgagtggtcagcagcacaatttgacaactcaacatcccccacgggatgcaagtcctgcagggcttttgtccattgcagaagagactttagcagaatttctttctaaggctactggaactgctgttgagtgggtccaaatgcctggaatgaagcctggtccggattccattggaatcgttgctatttctcacagttgcactggagtagcagcaagagcttgtggtttagtgggactagaacccactagggttgcagaaatcctcaaagatcggcctttgtggtttcaggattgccgagctgttgatgttctcaatgtgctgcccacagcaaatggtggaaccattgagctgctttatatgcagctatatgcaccaaccacattggctcctgctcgagacttctggttgttgcgctacacttctgttttagaagatggcagcttagtgatctgtgagaggtcacttaaaaatactcaaaatggtccaagcatgcctcctgtgcagcattttgttagagcagagatgctgcctagtgggtacctgatcagaccatgtgaaggaggcggttccatcatccacattgttgatcatatgaatttagagccatggagtgtgccagaagtgctacgtccactgtacgagtcatcaacggtactggctcagaagacatctatcgtggccctacgccatctaaggcagatttcacatgaagtttctcagtccaacgtcactgggtggggtaggagaccagcagcactacgagctcttagccaaagattgagccggggtttcaatgaggcactcaatgggtttactgatgagggatggacaacgattggcaatgatggtgtagatgatgttactattctagtgaactcatcccctgacaagttaatgggtctgaatctttcctttgccaatggatttccgtctgtcagtaatgcagtgctatgtgccaaagcatcgatgctattacagaatgtgccccctgccattctccttaggtttctgcgggagcatagatcagaatgggcagacaataatatggatgcttacacagctgctgctattaaagttggcccttgcagcttatcaggatctcgtgttggaaactatggaggtcaagttatactcccccttgcacacacaattgaacatgaggaggtcattaaattggaaggaattgctcattctcctgaagacacaataatgcccagagaaatgtttcttttgcaactttgcagtggaatggatgagaatgctgttggcacctgtgctgaacttatatctgctccaattgatgcttcctttgctgatgatgccccccttttaccttctggatttcgcatcattcctcttgaatctggaaaggaagcttccagccccaatcgcacccttgaccttgcatctgctctagacattggttccagtggaaaccgagcttcaaatgaatgtgctggaaattccagctatatgagatctgtgatgacaatagcttttgaatttgcatttgaaagccatatgcaagagcatgtagcatctatggcacgtcaatatgttcggagcattatatcatcggtccaaagggtagcattagcactttctccttctcatttgagttcacatgcagggcttaggtcaccattgggtactcctgaagcgcaaacccttgctcattggatttgcaacagttataggtgctacttgggtgtggagctacttaaatctaataatgaggggaatgaatctttgctcaagtccttgtggcatcactcagatgcaatattgtgctgcactctaaaggcattgccagtgttcactttctcgaaccaggctgggcttgacatgctggagaccacccttgttgcattacaagatacacctttagagaaaatatttgatgatcatggacgaaaaatacttttttcagagtttccccagattattcaacaggtggtatttgtctttcaagcatggggcgacctgtctcgtacgaaagagttgttgcttggaaggtgctga

SEQ ID NO: 161 - DNA, 2960 bp, Glycine max
gaggggaatgaatctttgctcaagtccttgtggcatcactcagatgcaatattgatcgttctatggttggcagatcggtgaagcggcggagcaaatggttgcagagattccatacatgactcgatcttagtttagttaggagcagcggtggaaagcctaatagaacaagtatgtcctgcaaggatggtagcagaaacggaatcggaatcggaatggataacgggaagtacgtgcgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctccaagctgtcaataggaagctgactgctatgaacaagctgctgatggaagagaatgataggttgcagaagcaggtgtctcaactcgtctatgaaaatggctattttcgtcaacacacccagattactacgcaggcaaccaaagacacaaactgtgaatcagttgtgacgagtggtcagcagcacaatttgataactcaacatcccccacgggatgcaagtcctgcagggcttttgtccattgcagaagagactttagcagaatttctttctaaggctactgggactgctgttgagtgggtccaaatgcctggaatgaagcctggtccggattccattggaatcgttgctatttctcatggttgcactggtgtggcagctagagcctgtggtctagtgggactagaacccactagggttgcagaaatcctcaaagatcagcctttgtggtttcgcgattgccgagctgttgatgttctcaatgtgctgcccacagcaagtggtggaaccattgagctgctttatatgcagctatatgcaccaaccacattggctcctgctcgagacttctggttgttgcgctacacttctgttttagaagatggaagcctagtgatctgcgagaggtctcttaaaaatactcaaaatggtccaagcatgcctcccgtgcagcattttgttagagctgagatgctgcctagtgggtacctgatcagaccttgtgaaggaggtggttcgatcatccacattgttgatcatatggatttagagccatggagtgtgccagaggtgctacgtccactgtacgaatcatcaacagtactggctcagaagacaactatggcggccctacgtcatctaaggcagatttcacatgaagtttctcagtccaacgtcactgggtggggtagacgaccggcagcactacgagctcttagccaaagattgagcaggggttttaatgaggcactcaatgggtttactgatgagggatggacaacaattggcaatgatggtgtagatgatgttactattctagtgaattcatcccctgacaagttaatgggtctgaatctttcctttgccaatggatttccgtctgttagtaatgcagtgctatgtgccaaagcatcgatgctattacagaatgtgccccctgccattctcctaaggttcctgagggagcatagatcagaatgggcagacaacaatatggatgcttacacagctgctgctattaaagtcggcccttgcagcctatcaggatctcgtgttggaaactatggaggtcaagttatactccccctagcacacacaattgagcatgaggagtttttggaagtcattaaattggaaggaatagctcattctcctgaagacacaataatgcctagagaaatgtttcttttgcaactctgcagtggaatggatgagaatgctgttggcacctgtgctgaacttatatctgctccaattgatgcttcgtttgctgatgatgcccccctcctaccttctggatttcgcatcattcctcttgaatctggaaaggaagcttccagccccaatcgcacacttgaccttgcatctgcccttgacgttggtcccagtggaaaccgagcttcaaatggatgtgctaattccagctgtatgagatctgtgatgacaatagcatttgaatttgcatttgaaagccatatgcaagagcatgtagcatctatggcacgccaatatgttcggagcattatatcatcagtccaaagggtagcattagcactttctccttctcatttgagttcacatgcagggcttaggtcaccattgggtactcctgaagcgcaaacccttgctcattggatctgcaacagttataggtgctacttgggtgtggagctacttaaatctaacaacgaggggaatgaatctttgctcaagtccttgtggcatcactcagatgcaatattgtgctgcactctaaaggcattgccagtgttcactttctcgaaccaggctgggcttgacatgcttgagaccaccctagttgcattacaagatataactttagagaaaatatttgatgatcatggacgaaaaattctcttttcagagtttccacagattatccaacagggttttgcatgtcttcaaggtggcatttgtctttcaagcatggggcgacctgtctcatatgaaagagttgttgcttggaaggtgctgaatgaagaagagaatgctcattgtatttgctttatgtttgtgaactggtcttttgtttgacatcttgttctgagtacacttgggcttattgtatccaagtgttagataaagttttactctaagactcttgtgtgctttgttggttggtgttttactgtatttgcactaaatacttggattgcactttaaatgactatttgtgttattattagcttatgtaacttgtttccttattcaaaaaaaaaaaaaaaatttatgcaatattaagaagtgttgcagctttttatgtgggaaaaaaaaaaaaaaaagaaaaaaaaaaaaaaaaaa

SEQ ID NO: 162 - DNA, 2925 bp, Glycine max
ctaggcttcagaccgtgaaccgcaaactcactgcaatgaacaagttgttgatggaggagaatgatcggttgcagaagcaggtgtcacagcttgtttgtgagaatggttttatgaggcagcaattgcatactccatcggcaacaactactgatgctagttgtgattcggtggttaccactcctcagcataccctgagagatgctagtaaccctgctggactcctatcaattgcagaggaaactttgacagagttcctttcaaaggctacaggaactgctgtagattgggtccagatgcctgggatgaagcctggtccggattcggttgggatctttgccatttcacaaagttgcagtggagtggcagctcgagcctgtggtcttgttagtttagaacctacaaagattgcagagatccttaaagatcgtccatcttggttccgtgactgtcggagcctagaagtttttactatgtttcctgctggaaatggaggaaccattgaacttgtttacacacagacatatgctccaacaacactggctcctgctcgggatttctggactctgagatataccacaagtttggaaaatggcagtcttgtggtttgtgagaggtccctgtctggttctggaactggccctaatccagctgctgctgctcagtttgtaagggctgaaacactccctagtggctacttgatccgaccatgtgaaggtggagggtcaatcattcacatagtagaccacctaaatctcgaggcatggagtgtgccagaagtgttgcggccactttatgaatcatccaaggtggttgctcagaaaatgacaattgcagcgcttcgctatatcaggcaaatagctcaggaaacaagtggtgaggttgtttatggattgggtaggcagcctgctgttctgcggactttcagccagagattgagcagaggcttcaatgacgctgtaaatggattcaatgatgatgggtggactgtattgaactgtgatggtgctgaggatgtaattattgctgttaattcaaccaagaatttgagtggcacttctaacccagcaagttcccttacattccttggaggaattctctgtgcaaaagcttctatgttgcttcaaaatgtccctcctgcagttttggttcgttttctgagggagcaccgctcagagtgggctgatttcaatgttgatgcttattctgctgcatcactgaaagctggcacctatgcctatccagggatgaggcctacaagattcactggcagtcaaataattatgcctcttggtcatacaattgaacatgaagagatgcttgaagttattaggttggaaggtcactctcttgctcaagaagacgcttttgtttctagggacattcatctcttacagatatgtagtgggattgatgagaatgctgtgggggcttgttcagagctcgtatttgctccaattgatgaaatgttccctgatgatgctccattggttccttctggtttccgcattatcccattagattcaaaaccaggtgacaaaaaggatgctgttgctacaaatcggaccctggatttgacatctggttttgaagttggtcctgcaacaactgctggtgcagatgcatcatcaagtcaaaacactcgatcggtgttgactattgccttccagttcccttttgacagcagtctgcaagacaacgtcgcggtcatggcacgccaatatgtccgcagtgtgatttcctccgtgcagagggttgccatggctatatctccatctggtataaacccatcaattggagctaaactttctcctggttctccagaggctgttacactagctcactggatctgccaaagttatagttactatttagggtccgacttactgagatcagattctcttgttggtgacatgatgctgaaacaactgtggcatcaccaggatgccattctatgctgttcactgaagtcattgccagtgttcatatttgcaaatcaagctggccttgacatgttggaaacaaccctagttgccttacaagatatcacattggataaaatatttgatgaggctggacgcaaggcattgtgtacagactttgccaagttaatggagcagggttttgcttatctgccagctggaatctgcatgtcgacgatggggcgccatgtgtcatatgaccaagccattgcatggaaagttcttactggggaagacaacactgttcactgcttggctttctctttcataaattggtcatttgtatgaaaaatccaattcgtgtgccctgctttttcccacttgaacataaaaatgaaagggttaaaagggagacaagacaagtttggggggaaaaagaagtcgtaaatttttgtataacacatcaggatcaggtttgcatttaattcgatttaatttatttcttatttagtgcagagaccaaattgaattaatcttgtaaattatttagtgctagagtgaagttgagacttttgaatgacacatgttgagtactttgtttttgtctctagtatctttcactcgagttgagctcatacacagaagaacttgtgtgatgacaaagcgcgtgtaatgtttcttacacaatcacagttctgacttgtgtgtccaatgtagtactttgtttttgtatgtagtatgatcatatctttcaactcgagttaaatattagcacacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccccccttttgggtctcgtccccccggaatttaattccggcccggtccctgggggggtcccagttttccttttaggggggcgttttaaagctgggggaaaaaagggaaatagttgt

SEQ ID NO: 163 - DNA, 4113 bp, Glycine max
agaacacatagtttatatcaccgtgtagtaaatattcagtatagtatagactatagagtggtaaataatcaattttgcgaataatgcaccatatttgtagacgtcctaataatatctgagtatgcaaaatgatattggtctgtcaattgtattcagggaaatgaagtggggcctatacgacacgaggagcaaagagagatgggaaccgttagtaacattggcttcccttcagtattcagagttcctctagattcacaagtactatcaaagcatatgaagaataaatcatcgtgcgattttatggttccttctaatcataactactctgttaggctgagtccaatatgttgtaagctatcagaaagtgggattgaggagaaccacacgagcacgagcacgggcgagaggccctctaagatcaaggacaggatggaggagtacaatatagctatgaagaaaatgatgaggaacccttatgagtatcaccatgatctgggtatgaattatactcttataacggacaatttgattgttggctcccaaccacagaaacctgaagacatagatcacctcaaaaaggaagagggtgtggcatacattttaaacttgcaacaagataacgatgttgagtattggggagtagacttgcagtcaataataagaaggtctcgtgaacttgaaattagccacacaaggagaccggcaaaagactttgatccagattccttgcaaaatgaactacctaaagcagtctcatccttagaatgggcaatttctgagggaaaaggaagagtttatgtgcattgtacggctggacttggaagagctccagcggtggcaattgcttatttgttctggttttgtgacatgaatctaaatgaagcatatgatatgctaacttcaaagagaccttgtggaccaaataaaagagcaatacgtggagctacttacgatttggctaagaatgatccgtggaaggagccatttgagaatcttccagaatatgcatttgaggatatagcagattgggaaaggaacttgattcaagatcgtgtccgctcccttcgtggaacttgataacttcggtttctacatattagagattcctacatagattaccacccttgctgggatggcgccagttgccatgatactgctcaagatggagattttttcaagcagattcatgctaatatgaacatatagtttataataacgtgtacgaaatattcagtatagtatatttgccctagtccccccccccctaggcttcagaccgtgaaccgcaaactcactgcaatgaacaagttgttgatggaggagaatgatcggttgcagaagcaggtgtcacagcttgtttgtgagaatggttttatgaggcagcaattgcatactccatcggcaacaactactgatgctagttgtgattcggtggttaccactcctcagcataccctgagagatgctagtaaccctgctggactcctatcaattgcagaggaaactttgacagagttcctttcaaaggctacaggaactgctgtagattgggtccagatgcctgggatgaagcctggtccggattcggttgggatctttgccatttcacaaagttgcagtggagtggcagctcgagcctgtggtcttgttagtttagaacctacaaagattgcagagatccttaaagatcgtccatcttggttccgtgactgtcggagcctagaagtttttactatgtttcctgctggaaatggaggaaccattgaacttgtttacacacagacatatgctccaacaacactggctcctgctcgggatttctggactctgagatataccacaagtttggaaaatggcagtcttgtggtttgtgagaggtccctgtctggttctggaactggccctaatccagctgctgctgctcagtttgtaagggctgaaacactccctagtggctacttgatccgaccatgtgaaggtggagggtcaatcattcacatagtagaccacctaaatctcgaggcatggagtgtgccagaagtgttgcggccactttatgaatcatccaaggtggttgctcagaaaatgacaattgcagcgcttcgctatatcaggcaaatagctcaggaaacaagtggtgaggttgtttatggattgggtaggcagcctgctgttctgcggactttcagccagagattgagcagaggcttcaatgacgctgtaaatggattcaatgatgatgggtggactgtattgaactgtgatggtgctgaggatgtaattattgctgttaattcaaccaagaatttgagtggcacttctaacccagcaagttcccttacattccttggaggaattctctgtgcaaaagcttctatgttgcttcaaaatgtccctcctgcagttttggttcgttttctgagggagcaccgctcagagtgggctgatttcaatgttgatgcttattctgctgcatcactgaaagctggcacctatgcctatccagggatgaggcctacaagattcactggcagtcaaataattatgcctcttggtcatacaattgaacatgaagagatgctggaagttattaggctggaaggtcactctcttgctcaagaagatgcttttgtttctagggacattcatctcttacagatatgtagtgggattgatgagaatgctgtgggggcttgttctgagcttgtatttgctccaattgatgaaatgttccccgatgatgctccattgattccttctggtttccgcattatcccattagattcaaaaccaggtgacaaaaaggaagttgctacaaatcggaccctggatttgacatctggttttgaagtgggtcctgcaacaactgctggcacagatgcatcatccagtcaaaacactcgatcagtgttgactattgccttccagttccctttcgacagcagtctgcaagacaatgtcgcagtcatggcacgtcagtatgtccgcagtgtgatttcttccgtgcagagggttgccatggctatatctccatctggtataaacccatctgttggagctaaactttctcctggttctccagaggctgttacactagctcactggatctgccaaagttatagttactatatagggtctgacttactgagatcagattctcttgttggtgacatgatgctgaaacaactgtggcatcaccaggatgcaattctatgctgttcactgaagtcattgccagtgttcatatttgcaaatcaagctggccttgacatgttggaaacaactctagtagctttacaagacatcacattggataaaatatttgatgaggctggacgcaaggcattgtgtacagactttgccaagttaatggagcagggatttgcttatctgccagctggaatctgcatgtcgacgatgggacgccatgtgtcatatgaccaagccattgcatggaaagtgcttactggagaagacaacactgttcactgcctggctttctctttcataaattggtcatttgtatgaaaatccaattcgcgtgccctgctttttcccacttgaacataaaaatgaaagggttaaaagggagacagtcaaatttggagggaaaaagaagtcctaaatttttgtataacacatcaggatcaggtatgcatttaattcgatttaatttatttcttatttagtgcagaaaccaaattgaattaatcttgtaaattatttagtgctagagtgaagttcagacttgaatgacacatgttgagtactttgtttttgtctctactatctttccctcgaccttaagctcatacacagaagaacttgtgtgatgacaaagcgcgtttgtaatgtttattcttacacaatcacagttctgacttgtgtgtccaacgtagtactatatattcttactggagtactttgtctttcaactcgagttaagcattagggtacatttgtatctgaagtactatgcatttgtacaacctatctgtattttaagattgctaaagttataaactgaagtgttaaatcaaaaaaaaaaaaaaaaaaatctttcggggggcaaatcgttccccagaatcaaggtctgtcttatttgccatccac

SEQ ID NO: 164 - DNA, 1018 bp, Glycine max
tcgtctctttcttcttctctctctctctctcacaatctcgagattggtgtgtgtgtgtgttgggggagataaagaccactgttgcccactcaggtttctcttccaagtttggattttgagggaacttacagcatctaatgaaggagagtggaggctctcttggagaagagagcacccccaccaccaacagcagtgaagaagaagaaccaattaactagttcctttccttctttctctcacccattcccatttttaacctaatagtagtgtaggtttaaagaaatatagtgtgttagagtgatggcactttctatgcacaaggactcagccaacaaccagatggactcgagcaagtatgtgaggtacacaccagagcaggttgaggctttggagagggtatatgctgaatgccctaagccgagttccttaagaagacaacaactcatcagagagtgccccatcctctccaacattgaaccgaaacagatcaaagtttgggtttcaaacagaaggtgtcgtgagaagcagaggaaggaagcttctcggctgcagacagtgaacagaaagctgactgcaatgaacaagcttttaatggaggaaaatgaccgtttgcagaagcaggtttctcatctggtttatgagaatggttacatgaagcaacagatacacactgcttctgcaggtactaccacagacaatagctgtgagtctgtggttatgagtggtcaaaaccaacagcaaaacccaacacctcagcatcccaatagggatgctaacaacccagctggtcttctcgccatagctgaggagaccctggcagagttcctttccaaggctactggaactgctgtcgactgggtccagatgattgggatgaagcctggtccggattctattggaatcgttgctgtttcccgcaactgtagtggcgtggcagcacgagcctgcggccttgtgagcctagagcccactaaagttgctgagatactaaaagatcgacagtcgtggtatcgtgact

SEQ ID NO: 165 - DNA, 3404 bp, Glycine max
  misc_feature (3150)..(3150): n is a, c, g, or t
ccacgcgtccgctctttctcctttctttttctctctttctctacaatctcgagattggtgtgtggagcgtccgaaagaccactgtttcccccctttagtttctcttctaagttggattttgaaggaactgagcagcatctaatgaaggagagtggaggctctcttggagaagagagcctgcccgagactaacaccaagaacagtgaagaagaagaaccaattaactagttcctttttttctttctttctttctcactcactccctccctcccaatcccattttcttcaaatagtgtgcgtgtgtgtgttaagagaagaatagggtgtgtgtgtttagagtgatggcactttctatgcacaaggactcagccaacaaccagatggattcaagcaagtatgtgaggtacacaccagagcaggttgaggctttggagagggtctatgctgaatgccctaagccaagttccttgaggaggcagcaactcatcagagagtgccccatactttccaacattgaacccaaacagatcaaagtttggttccagaatagaaggtgtcgtgagaagcagaggaaggaagcttctcgcttgcagacagtgaacagaaagctgactgcaatgaacaagctgttaatggaggagaatgaccgtttgcagaagcaggtttctcatctggtgtatgagaatggttacatgaagcaacagatacacactgcttctgctggtactaccacagacaatagctgtgagtctgtggtaatgagtggtcaaaaccaacagcaaaacccaacacctcagcatccggctcgaggattatttgtttgtttcagtcttctcgccatagctgaggagaccctggcagagttcctttccaaggctactggaactgctgtcgactgggtccagatgattgggatgaagcctggtccggattctattggaatcgttgctgtttcccgcaactgtagtggcgtggcagcacgagcctgcggccttgtgagcctagagcccactaaggttgctgagatactaaaagatcgacagtcgtggtatcgtgactgtcgatgcgtggatgtgttaagtatagtccccactgggaatgggggcaccatcgagctcctgtacatgcagacatatgcgcccacaactttggctgcagcacgggacttctggacactgagatacacgacaagtttggaagatggaagtcttgtgatatgtgagagatcattgacttcttcaactggtggccccacagggcctgctgcttcaaacttcgtacgagctgaaatgcttcccagtggctatctaattagatcctgtgagggtggtggatccattattcacattgttgatcatgttgatttagatgtctggagtgttcctgaagtacttagacccctgtatgaatcaccaaaattcttggctcagaaattgactactgctgccttgcgacatgtaagacaaattgcacaagaatcaagtggagaagttcagtatggtgggggtcgtcagcctgctgtcttgaggacatttagtcaaaggctttgcaaagggttcaatgatgctgtcaatgggtttgtggatgatggttggtcactgatgggtaatgatggggtggaagatgtgaccatagccataaactcatctccaaacaaatttttgggctccaattacaacgcatcaatgtttccagcatttggaggtggggtcttgtgtgccaaggcatcaatgctcctgcagaatgttcctcctgctttgcttgttcggtttttgagggagcatcgatcagagtgggctgattatggagttgatgcatactctgccgcatgccttaaagctagtccctatgcagttccttgtgcaagacctggaggcttccccagcacccaggtcattttaccccttgctcatactattgagcacgaggagttcctggaggtagttcgaatagagggtcatgcattttctcctgaggacgtagcgttggcacgtgatatgtatctattgcagctgtgcagtggagttgatgaaagtgcagttggggcatgtgctcagcttgtgtttgcacctattgatgagtcatttgctgatgatgctctcttactgccttctggtttccgtgtcattccattgcttcctttgccggatggcttggcttcatctaggacctgggtcttagcatcaacactgggcgcaggatctggtaatgcccgctcagctggccacacgtgactcgaataactacaaccttaggtcggtcctcacaattgcattccaatttacctttgagaaccatttgcgggacaatgtggctgttatggctcgccagtatgtgcgtaatgttgtggcgatctgttcagagggttgccatggcaattgctccctctaggatcagtacacagttggggccaaagtcacttcctggtccaccagaggcccttaccttagcaagatggatctgcaaaagctacagtctccacacctgcacagagctttttagcgttgagtccacatctggtgatgcaatcttgaagcaactttggcaccatccagatgcaatattgtgctgttctgtaaaaacaaatgcatctccagtgttcacctttgcaaaccaagctggacttgacatgcttgaaaccactcttgttgctcttcaagacataatgctggataaagttcttgatgaagctggcaggaagtttctctgcattgagttctccaagataatgcaacagggatttgcatatctgccagcaggaatatgtgtatcaagtatgaatcgaccagtgtcttatgagcaggccattgcttggaaagttctcgatgatgatgattccaatcactgccttgccttcgtattcatgaactggtcttttgtctgatgggggaaccatcatttagatactttattatatctattaatttatattttgagtactttactaagatattgtcacaccaacaacgaatgtaactaatgactggatttcatgaactcatggttgtgtgtgccattagattagctttgctttatgcttttaccaaggatgtacctttcttactatataaactccttgttgaagtatagcctacttattcctaaaaaaaaaaaataaaaaaaaaaataaaaaaaaattaaaaaaaaaanataaaaattgaaatactgaaaaaaaaaaaaaaaaaaaaaaaaaaaaaaaagaaaaggggcgccccccaaatatggacccccccaacccgaaaataaatccggaaccggaacctgaaggcgtcccatttttccttataggaattaaaattaaacctgggcaaaaccatggccttaccttttcccgggggaaaatggtttcccgttccaattcccaaaaaaaatccgacccgaaaccttaaaggcaaaagccgggg

SEQ ID NO: 166 - DNA, 2319 bp, Glycine max
atgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctgcaagctgtcaataggaagctgactgctatgaacaagctgctgatggaagagaatgataggttgcagaagcagactacgcaggcaaccaaagacacaaactgtgaatcagttgtgacgagtggtcagcagcacaatttgataactcaacatcccccacgggatgcaagtcctgcagggcttttgtccattgcagaagagactttagcagaatttctttctaaggctactgggactgctgttgagtgggtccaaatgcctggaatgaagcctggtccggattccattggaatcgttgctatttctcatggttgcactggtgtggcagctagagcctgtggtctagtgggactagaacccactagggttgcagaaatcctcaaagatcagcctttgtggtttcgcgattgccgagctgttgatgttctcaatgtgctgcccacagcaaatggtggaaccattgagctgctttatatgcagctatatgcaccaaccacattggctcctgctcgagacttctggttgttgcgctacacttctgttttagaagatggaagcctagtgatctgcgagaggtctcttaaaaatactcaaaatggtccaagcatgcctcccgtgcagcattttgttagagctgagatgctgcctagtgggtacctgatcagaccttgtgaaggaggtggttcgatcatccacattgttgatcatatggatttagagccatggagtgtgccagaggtgctacgtccactgtacgaatcatcaacagtactggctcagaagacaactatggcggccctacgtcatctaaggcagatttcacatgaagtttctcagtccaacgtcactgggtggggtagacgaccggcagcactacgagctcttagccaaagattgagcaggggttttaatgaggcactcaatgggtttactgatgagggatggacaacaattggcaatgatggtgtagatgatgttactattctagtgaattcatcccctgacaagttaatgggtctgaatctttcctttgccaatggatttccgtctgttagtaatgcagtgctatgtgccaaagcatcgatgctattacagaatgtgccccctgccattctcctaaggttcctgagggagcatagatcagaatgggcagacaacaatatggatgcttacacagctgctgctattaaagtcggcccttgcagcctatcaggatctcgtgttggaaactatggaggtcaagttatactccccctagcacacacaattgagcatgaggagtttttggaagtcattaaattggaaggaatagctcattctcctgaagacacaataatgcctagagaaatgtttcttttgcaactctgcagtggaatggatgagaatgctgttggcacctgtgctgaacttatatctgctccaattgatgcttcctttgctgatgatgcccccctcctaccttctggatttcgcatcattcctcttgaatctggaaaggaagcttccagccccaatcgcacacttgaccttgcatctgcccttgacgttggtcccagtggaaaccgagcttcaaatggatgtgctaattccagctgtatgagatctgtgatgacaatagcatttgaatttgcatttgaaagccatatgcaagagcatgtagcatctatggcacgccaatatgttcggagcattatatcatcagtccaaagggtagcattagcactttctccttctcatttgagttcacatgcagggcttaggtcaccattgggtactcctgaagcgcaaacccttgctcattggatctgcaacagttataggtgctacttgggtgtggagctacttaaatctaacaacgaggggaatgaatctttgctcaagtccttgtggcatcactcagatgcaatattgtgctgcactctaaaggcattgccagtgttcactttctcgaaccaggctgggcttgacatgcttgagaccaccctagttgcattacaagatataactttagagaaaatatttgatgatcatggacgaaaaattctcttttcagagtttccacagattatccaacag

SEQ ID NO: 167 - DNA, 1321 bp, Glycine max
  misc_feature (1033)..(1033): n is a, c, g, or t
  misc_feature (1035)..(1035): n is a, c, g, or t
  misc_feature (1037)..(1037): n is a, c, g, or t
  misc_feature (1042)..(1042): n is a, c, g, or t
  misc_feature (1047)..(1047): n is a, c, g, or t
  misc_feature (1049)..(1049): n is a, c, g, or t
  misc_feature (1051)..(1051): n is a, c, g, or t
  misc_feature (1055)..(1056): n is a, c, g, or t
  misc_feature (1153)..(1153): n is a, c, g, or t
  misc_feature (1183)..(1183): n is a, c, g, or t
  misc_feature (1200)..(1200): n is a, c, g, or t
  misc_feature (1290)..(1290): n is a, c, g, or t
ccacgcgtccgcactcctgagctagctagggtttccactttccccatttcctctctcccacgtcttcgtctttctagaaaagcaaaaaacaattcacactttcacagtgccaaagattctcttctgccaatttcacttcacacatccatccatccatccatccatgtcttgaaacgatgcttcgcagatcaagcatagtcgattccaattcgcgcaagctcatggacggagatcgctgatacggcgaaccagatcgttgcacgagattcgtcacgtgacactcgatcttagttaggactagtgctagaaagcagaagctacttggttcttttgaaggtttgatttggatgtggaaataatgtcctgcaaggatggtagcagaaacggaatcggaatggataacgggaagtatgtccgttacacgcctgagcaggttgaagccctagaaaggctctatcacgattgccccaaacctagttccattcgccgccagcagctcattcgcgagtgccccattctctccaacatcgaacccaagcaaatcaaggtttggttccagaacagaagatgtagagagaagcagagaaaggagtcgtcgcggctgcaagctgtcaataggaagctgactgctatgaacaagctgctgatggaagagaatgataggttgcagaagcaggtgtctcaactcgtctatgaaaatggctattttcgtcaacacacccagattactacgcaggcaaccaaagacacaaactgtgaatcagttgtgacgagtggtcagcagcacaatttgataactcaacatcccccacgggatgcaagtcctgcagggcttttgtccattgcagaagagactttagcagaatttctttctaaggctactggaactgctgttgagtgggtccaaatgcctggaatgaagcctggtccggattccattggaatcgttgctatttctcacagttgcactggagtagcagcaagagcttgtggtttagtgggactagaacccactagggttgcagaaatcctnananatcgncctgnantntctnntgatttgccgagctgttgatgttctcaatgtgctgcccacagcaaatggtggaaccattgagctgctttatatgcagctatatgcaccaaccacatnggctcctgctcgagacttctggttgttgcnctacacttctgttttanaagatggcagcttagtgatctgtgagaggtcacttaaaaatactcaaaatggtccaagcatgcctcctgtgcagcattttgttagagcanagatgctgcctagtgggtacctgatcagacc

SEQ ID NO: 168 - DNA, 645 bp, Glycine max
atgaatcatcgaccacctttccaagaccacatgatgctcatgtctcagttattccctgctgatgcatacactcaaattatttctcaacaaggagagactaataagaagccaagacgccgtcgtaacaagaagaacaaaggaggagaaaacggtgcctcggaagccaacaagaagaggaagcttagtgaggtgcaagttaatttacttgaacaaaactttggaaatgaacgcaaacttgagtccgaaagaaaggataggctggcaatggagcttggtttggaccctcgacaagttgctgtgtggtttcaaaacagaagagcccgttggaagaacaaaaagttggaagaagagtactccagccttaaaaaaaatcatgaagccaccttgcttgagaaatgttgcctggagagtgaggtgttgaagctcaaagagcaactttctgaggcagagaaagagattcagaggctgctagagagtgccgagagagtcccaagcaacagttctagttcgtcacagtcacaatcaatggaagcggtggacccaccattctttggggaatttggagttgatggatatgaggatgatgtgttttacgtgcctgagacccattacatcaacggcatggaatggattaatctgtatatg

SEQ ID NO: 169 - DNA, 1584 bp, Glycine max
atgggtacaataactggcataagtgatttggattctgttcggtggccaaattctcattggcgctctgtcaaggttggttgggatgaatcaacagctggagagagacaaccacgagtgtctctgtgggaaattgagccattaacaacattcccgatgtatccatcattatttcccctcagactgaaacgtccatggcatcctggcacctcatctttgcatgatgggagagatgaagctactaatgggctaatgtggatgagaggtggacctgtagaccaaggtctcaattccctaaattttcaaggagctggtatgttgccctggatgcagcagagactggatccaactttactaggaaatgatcagaatcaacagtaccaagccatgttggcagctggtttacagaacttaggtagtggatatctcatgaagcaacaaatgatgaattttcagcagccttaccactatcttcaacaatctggaaacagtaattctcctttgcaacttcagcagcagcaaccaattcaacaatctgtgtcttctaacatgctgcagccacaagctcacgtgttgacagagaacttctctcagcacctccttcagaaaccacataacaatcaagaagtccaagcacaacagcagcaacatacttatcaagactcgctcttaattccgagtgatcaactccatcagagacaacactctggcattccttcaccatcatattcaaaaccggatttcttggattcgagcatgaagttccctgcttcagtttctcccgggcaaaacatgcttagttcactttgtcctgaaggaagtggcagtctcttgaatttatcgaggagcagtctgtccttgctgactgaacagttaccgcaacagcaatggactcaaaaatatgcacctgtgcaggtcaacacctatggaggcactgtgtcacatgcacaatattctggaaaagattctgcaatggtgctaccacattgtaactcggatgcccaaaattctacgctttttggtgtcaatattgattcatctggccttctccccatcacagtccctggttacaccacctcgtctgctgacactaattcatcaacaatgccattagcggattctggtttccagggttctctatatggttgcatggattcatcggagttgttgcaaagcgcagggcatgttgacccagaaaaccagagtcaaacctttgtcaaggtttacaaatcagggtcagttgggcgctcacttgacatatccaggttcagcagctatcatgaactacgcgaggagttggctcagatgtttggaattgaggggaagttagaagaccctcttagatcaggctggcagcttgtgttcgttgacagggagaatgatgttcttctccttggagatgatccgtgggaatcattcgtcaataatgtttggtatatcaaaatactttcacctgaagacattcagaaaatgggggaacaagcggtagaatcccttgcattaggttcaggacaaaggctaaatggcactggtgccgagtctcaggacatagtttctggaccaccatcaattggctcacttgagtac

SEQ ID NO: 170 - DNA, 2208 bp, Glycine max
ctttagcaaagtatgttaaagctgtatatcatactcgagtttcagttggtatgcgcttcaggatgctgtttgaaacagaggaatctagtgtgcgtcgatacatgggcacaataactggcattagtgacttggattctattcggtggccaaattcccattggcgctcagtcaaggttggctgggatgaatccacagcaggagagaggcaacctcgagtgtctttatgggaaattgagccattaacaacatttccaatgtatccatctccatttccccttaggcttaagagaccgtggcctccaggactgcctttgttccatgcaggcttgaaggatgatgattttggaataaattcttcactaatgtggcttcgagacacagacagaggtcttccatctcttaattttcagggtattggtgttagtccttggatgcagccaaggcttgatccctcaatggtgaattatcaatcagatatgtaccaagctatggctgccgctgcacttcaggatatgtggacttcaaatccttccaaacagcatcctacttcctcaattcagtttcagcaaccgcagaacttccccaaccagacttctcccttaatgcaaactcaattgttgcagcagtctccatctcagcaggcttttccaaatagtcaagaaaatccacatccgtctccatctcaatctcaggctcaaactcaaacacactttcagcagcatctacagcatcagcactcattcaataatcagaatcagcatcatcttctgccgcagcagcagcaacaaccacaacaaccgcagttgcaacagcaacaagtggtagatcatccacagatttcaagtgttgtctcttacaatgtctcagtttggttcagcagctcagtctcaatcaccacccatgcaagctatctcttcacttggccatcagcaaagcttttctgattcaaatggaaaccccacgactactgctattgtttctcccctgcatagtatattggattcatttcctcaggatgacacatctcaccttctcagccttcctagatccacttcttgggttcctgttcaacattcgactgcatggccaccctccaagcgtgttgtggtggatcctctcctttcttctggagcatctcaatgtgttctgcctcaagtggagcagttagggcagccacatagtaccatggctcaaaatggcattgcattgccagcctttcctggtagggagtgtacaatagaaggaagcaatgatccacaaaatcatcttttgtttggtgtcaatatagagccctcgtcacttctaatgcataatgggatgtcaagtcttaagggagtcagcagcaacagtgactcacccaccataccttttcaatcatctaattacctgaacaccacagtacctgattcttcattgaatcctggaatgacacacaatattggtgaatcgggcttcctgcaaactccagaaaatggggggcaaggaaacccaactaacaaaacctttgtgaaggtttacaagtcagggtcctttggaagatccttggacatcactaaattcaccagctaccctgagctacgcagtgagcttgctcgtatgtttggcctggaaggtgagttggaggaccctgtgagatcaggctggcagcttgtattcgttgaccaagagaatgacgttcttctccttggtgatggcccgtggccggaatttgtaaatagtgtagggtgcatcaagatactttcccctcaggaagtgcagcaaatgggcaacaatggccttgagcttcttaactctgtccccattcagaggctctctaacggcgtctgtgacgactacgcaggccgtgaggacccaagaaatttaagcactgggataacaattgtggggtctttaaactactgaatgatgtgacaatcaatactatgaatctcttctctctcttgtattattactcctacttctccactctttgtcaatggtgggatgtactgcctagttgtagtttataggctacttataagccttttgttttttttgtctgttttcctgttttttgctgcctaggaccattcataagataaacaatgtaaaccatatggcatcttgtcaatgtgctatctacaatatattgattacttaatctgttaggagttcaatgcccagaaagttacaaaaaaaaaaaaaaaaaagtaaaaaaacaaaaaagaa

SEQ ID NO: 171 - DNA, 2640 bp, Glycine max
attaagtgggtggccctcgaattttgaacaggaatccaagagcttgttctaggattcctgttcaaaattcaagtgggtggccctcgaagcgtgttgcggaggatcctctcctttcttccggagcctctcaatgtgttctacctcaggtggagcagctagggcaaccacagagtaccatgtctcaaaatgctatttctttaccaccttttcctggtagggagtgctcactagaccaagaagggagcaatgatccacaaaaccatctcttatttggcgttaatatagagccctcgtcccttgtcatgcctaatggaatgacaagccttaagggggactgaggaaacaatggctataccattagcgaagtatgttaaagctgtgtatcatactcgagtttcagttggtatgcggttcaggatgctgtttgaaacagaggagtcaagtgtgcggagatacatgggtacaataactggcattagtgacctggatcctgtccggtggcaaaactcacattggcgctccgtcaaggttggctgggatgaatccactgctggagacaggcaacctagagtgtctctttgggaaattgagccattaactacatttcctatgtatccatctccattcccccttaggcttaaacggccatggcctccaggactgccttcattccatggcatgaaggatgacgattttggcccgaattcacctctgttgtggctccgagatcctgatagagggcttccgtctcttaattttcaggggattgggattaatccttggatgcagccaagatttgatcccaccatgttgaatatgcaaacagacatgtaccaagctgcggctgttcaggacatgaggagtttagatccttccaaacagcattctgcttccttacttccatttcagcaaccacagaacttcccaaacaggactgctgctttaatgcaggcccagatgttgcagcagtcacaacctcagcagatttttggaaatactcaagagaatcaacattccccacaatctcaggctcatcttcagcaacatctacaacatcaacactcgttcaatagtcagcatcatcatcaccaccagcaacaacaacagcgacagcaacatcaagtggtagataatcaacagatttctagtgcagtctctacaatgtctcagtttgtttcagctcctcaacctcaatcaccacctatgcaagttatctcttccatgtgccaacagcaaaacttttctgattcaaacgggaacactgtgactactattgtttctcccctgcacagtatcttgggttcttttccccaggatgaaacatctcacctcctgaaccttcctagaacaagctcttggattcctgttcaaaattcaagtgggtggccctcgaagcgtgttgcagtggatcctctcctttcttccggagcctctcaatgtgttctacctcaggtggagcagctagggcagccacagagtaccatgtctcaaaatgctatttctttaccaccttttcctggtagggagtgctcaatagaccaagaagggagcaatgatccacaaaaccatctcttatttggtgttaatatagagccctcgtcccttctcatgcctaatggaatgtcaagccttaagggggtctgtggaaacaatggctcctcaaccttgccatatcaatcttctaattatctgaatactaccacacggactgattcttcattgaatcatggaatgacccccaacataggcgactcgggtttcctgcagtgtctggaagaggcaggacaaggaaacccactgaacaaaacctttgtgaaggtttataagtcagggtcctttggaaggtcattggatatcactaaattcagcagctaccatgagctgcgtggtgaactcgctcgaatgtttggccttgaaggcgagttggaggaccctgtgagatcaggctggcagcttgtatttgtagaccgagagaacgatgttcttctccttggtgatggcccctggccggaattcgtaaatagcgtatggtgcataaagatactttctcctcaggaagtgcagcagatgggcaacaatggccttgagctgttgaactcgtttccaattcaaaggctctctaatggcatctgtgatgactatgtgagccgtcaagacccaagaaatttaggcactgggataacaaccgtggggtctttagactactaaatagtcttcacttcttctatcacatgtaatattattacccttacttctcaaccctttctttgtgtacggtgggaagcacctttgcctaagtgtagtttacatagcctactctttagcctttggatgttttcctgttttttcctgctaggacatttcataaactaatactgtaactatatggcatctagtcattgtgctagccacaatatatacgatacttaatccgttaggaaatcaatgcgtgagatatgttctcttaacttgtacagaactttttctttctagtttggttttattttggcttaaatgtttgggggtgcatgatttgactatgaagcatactaggcaatggagtggaggtgatgttgaacttggttgacctttaatgtctatcaaaatatttatttattttgttgggaaaaaaaaaaaaaa

SEQ ID NO: 172 - DNA, 2182 bp, Glycine max
ggctcgaggtccgcaggtatatgggtacaataactggcataagtgatttggattctgttcggtggccaaattctcattggcgctctgtcaaggttggttgggatgaatcaacagctggagagagacaaccacgagtgtctctgtgggaaattgagccattaacaacattcccgatgtatccatcattatttcccctcagactgaaacgtccatggcatcctggcacctcatctttgcatgatgggagagatgaagctactaatgggctaatgtggatgagaggtggacctgtagaccaaggtctcaattccctaaattttcaaggagctggtatgttgccctggatgcagcagagactggatccaactttactaggaaatgatcagaatcaacagtaccaagccatgttggcagctggtttacagaacttaggtagtggatatctcatgaagcaacaaatgatgaattttcagcagccttaccactatcttcaacaatctggaaacagtaattctcctttgcaacttcagcagcagcaaccaattcaacaatctgtgtcttctaacatgctgcagccacaagctcacgtgttgacagagaacttctctcagcacctccttcagaaaccacataacaatcaagaagtccaagcacaacagcagcaacatacttatcaagactcgctcttaattccgagtgatcaactccatcagagacaacactctggcattccttcaccatcatattcaaaaccggatttcttggattcgagcatgaagttccctgcttcagtttctcccgggcaaaacatgcttagttcactttgtcctgaaggaagtggcagtctcttgaatttatcgaggagcagtctgtccttgctgactgaacagttaccgcaacagcaatggactcaaaaatatgcacctgtgcaggtcaacacctatggaggcactgtgtcacatgcacaatattctggaaaagattctgcaatggtgctaccacattgtaactcggatgcccaaaattctacgctttttggtgtcaatattgattcatctggccttctccccatcacagtccctggttacaccacctcgtctgctgacactaattcatcaacaatgccattagcggattctggtttccagggttctctatatggttgcatggattcatcggagttgttgcaaagcgcagggcatgttgacccagaaaaccagagtcaaacctttgtcaaggtttacaaatcagggtcagttgggcgctcacttgacatatccaggttcagcagctatcatgaactacgcgaggagttggctcagatgtttggaattgaggggaagttagaagaccctcttagatcaggctggcagcttgtgttcgttgacagggagaatgatgttcttctccttggagatgatccgtgggaatcattcgtcaataatgtttggtatatcaaaatactttcacctgaagacattcagaaaatgggggaacaagcggtagaatcccttgcattaggttcaggacaaaggctaaatggcactggtgccgagtctcaggacatagtttctggaccaccatcaattggctcacttgagtactgagaaaattgaaacatgtattccttcagaccccatggtcaagagaatttctctacatgtttttattacttaagttggaatatgttgtgtatgatctgttcccccctctcaccctcattattactatcagcatttgaagaaaaatatacatttatgattaaaaaaaaaccttaggacatgcttctgtgccaatttgaacttggggcactgcaagctagagttagtgttactgctattttagcataatattttattcaacttttgcatgaactaatgtactctagataggaaactagagaaggctgtttatgcttttgaactgtctatgtattctaaaatgccatcacttcccagttaaggggtcgaacttttacctcaaaaaatgtatgagtagtattttactatattgccattgaaaccatcaacccaccatacgacatgtctcttaaatgctactattttgtagctctataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagg

SEQ ID NO: 173 - DNA, 2409 bp, Glycine max
actgtcatgccatcctcagttctatctagtgatagtatgcacattgggcttcttgcagctgctgctcatgctgcagcaactaatagctgctttacagtgttctataacccaagggctagtccatctgaatttgtcataccgctttcaaaatcgatatcaaagctgtgtaccatacacgcgtttctgttggtatgcgtttcaggatgctttttgagactgaagaatcaagtgtccgcaggtacatgggtacaataactggcataagtgaccttgatcctgttcgttggccgaattctcattggcggtctgttaaggttggttgggatgaatcgacagcaggagagagacagcctcgggtatcattatgggaaattgagcctttaacaacatttccaatgtatccatctctatttcccctcagattgaaacggccatggcatcctggcacctcttcttttcatgatggcagagatgaagcaactaatgggcttatgtggctaaggggtggacctggagaccaagctctcaattccctgaattttcaaggttctggtttgttgccatggatgcagcagagaatggatccaacattacttggaaatgatcataatcagcaataccaagccatgtttgcatctggtttgcagaacttaggtagtggatatctcatgaagcaacaaatgatgaattttcagcagccttaccactatcttcaacaatctggaaacagtaattctcctttgcaacttcagcagcagcaaccaattcaacaatctgtgtcttctaacatgctgcagccacaagctcacgtgttgacagagaacctctctcagcacctccttcagaaaccacataacaatcaagaagtccaagcacaacagcagcaacatacttatcaagactcgctcttaattccgagtgatcaactccatcagagacaacactctggcattccttcaccatcatattcaaaaccggatttcttggattcgagcatgaagttccctgcttcagtttcccctgggcaaaacatgcttagttcactttgtcccgaaggaagtggcagtctcttgaatttatccaggagtggtcagtccttgctgaccgaacagttaccccaacagcaatggactcaaaaatatgcacctgtgcaggtcaatgcctatggaagcactgtgtcacatccacaatattccggaaaagattctgtaatggtgctaccacattgtaactcagatgcccaaaattctactctttttggtgtcaatatcgattcatctggccttctcctccccaccaccgtccctggttacaccacctcgtccgctgacactaattcatcaacaatgccattagcggagtctggtttccagggttctctatatggttgcatgcaagattcatcggagttgttgcaaagtgcagggcatactgacccagaaaaccagactcaaacctttgtcaaggtttacaaatcagggtcagttggacgctcacttgacatatcccggttcagcagctatcatgaactgcgtgaggagttggctcagatgtttggaattgaggggaagttagaagaccctcttagatcaggctggcagcttgtgttcgtcgacagggagaacgatgttcttctccttggagatgatccgtgggaatcatttgtcaataatgtttggtatatcaaaatactttcacctgaagacattcagaaaatgggggatcaagcggtagaatcccttgctctaggttcaggacaaaggctaaacggcactggtgctgagtctcaggacattgtttctggaccaccatcaatcggctcacttgagtactgagaaaactgaaacatgtattccttcagaccaccatggtcaagagaatttctctacatgttttattacttaagttggaatatgttgtgtatgatctgttccccctttcagccctccttattattactatcagcattgaagaaaagtatacatttatgattaaaaaaaaacccttaggacatgcttctgtgccaatttgaacttggagcactgcaagctagagttagtgttaatgctattttagcataatatttgatcaaacttttgcatgaactaatgtactctagataggaaactagagaaggctgtttatgcttgagctgtctttgtattctacaatgccattagttcccagttaaggggtcgaacttttaactcaaaatgtatgagtagtattttactatattgccattgaaaccatcaacccaccatacgacatgtctcttaaatgctactattttgtagctctataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagg

SEQ ID NO: 174 - DNA, 2295 bp, Glycine max
  misc_feature (2269)..(2269): n is a, c, g, or t
  misc_feature (2276)..(2276): n is a, c, g, or t
attcggctcgagtattattctgagtgtggtgcaagccacctatgtactatttttcctttacttatgcaaaagctacctttgtactatttttcctttacttctgcacaagccacctttgttttgtccgcaggtacatgggtacaataactggcataagtgacctggatcctgttcgttggccgaattctcattggcgatctgttaaggttggttgggacgaatcaaccgctggagagagacagccacgggtatcattatgggaaattgagcctttaacaacgtttccaatgtatccatctctatttcccctcagattgaaacgaccctggcatccgggcacctcttcttttcatgatggcagagatgaagcaactaatgggcttatgtggctgaggggtggacctggagaccaagctctcaattccctgaattttcaaggttctggtttgttgccatggatgcagcagagaatggatccaactttacttgcaaatgatcataatcagcactaccaagccatgtttgcatctggtttgcagaacttagggagtggagatttaatgagacaacaaataatgaattttcaacagccttcaattatcttcaacaatcaggaaaccccaatcctcctttgcagcttcagcaaccgcaagcaattcagcaatccgtatcttctaataatattctacagccacaagcccaagtaatggcagagaacctgtctcagcacctccttcagaaatcacacaacaatcgagaagaccaaacacagcagcagcagcagcagcggcacacttatcaagatacagttttacttcaaagtgatcagctccatcagaggcaacactctggtctaccttcaccgtcatattcaaaaccagatttcttagattcaagcatgaagttccctgcttcagtttcaccaggacaaaacattcttggttcactttgtcctgaagggagtggtaatctcttgaatttatccagaagtggtcagtccatgctgactgaacagttacctcaacaatcatgggccccaaaattcacaccgttgcaggttaatgcttttggcaactcaatgcaacatgtgcagtattctggaaaagataccgcaatggtgccaccacattgtaactcggacacccaaaatcctattctatttggggtcaacatcgattcatctggtcttctgctccctacgactgtcccgcgttatactactgcatcagcggatagtgatgcatcagcaatgccattaggagagtctggattccagtctcctttatatccttgtggtcaagattcatcagagttggtgcaaagtgcagggcaagttgaccctcaaaaccagacacgaacattcgtcaaggtttacaaatcagggtcagttgggcgctcacttgacatctcccggttcagcagttatcatgagctgcgggaggagttggcacagatgtttggtattgaggggaaattagaagaccctcttagatcaggctggcagcttgtattcgtcgacagggagaacgatgttcttctccttggagacgatcccgtgggaatcatttgtcaataatgtatggtatatcaaaatactttcacctgaagatatccataaaatgggagaacaagccctggaatcccttggtccaagtccaggacagaggctgaatagcactggtgcagattctcatgaaattgtttcaggactaccatcaattggctcccttgaatactgagagaattttaacatgtatttttctctcaggtcctacggttaagaagactattacatatccacatgtttagtacttctgtttgaacactacttttcgaccttgcatatctgaatcaatatatactgtattgtctgtttcactttcaaaaacatcgttattatttcgtagaggattgttgagattttcaggacaaaaaatctatattatatatatgatgagaaagaaacctaggacaaacttttgtgccaatttgtaacttgtgctctgaaagctagaaatagtgttactactatgtaaaaaaaaaaaaaaaaatttgatcaaacttttgcatgaactaatgttctttagataggagcccaaaaaaggctgtttatgcttgagctgtctttgtattctacaatgccattagttcccagttaaggggtcgaacttttaactcaaaatgtatgagtagtattttactatattgccattgaaaccaaaaaaaaagtaaaaaaataaaaaaaaaaaaaaaaaaaaaaaagagggcngcgccgntcttataagagatatcaag

SEQ ID NO: 175 - DNA, 2280 bp, Glycine max
ataatcctagggcaagcccatctgaatttgtcattcctttggccaagtacgttaaagctgtgtatcatacacgagtttctgttggcatgcgatttaggatgctatttgagacagaagaatcaagtgttcgccgatacatgggtaccataactggtattagtgatttagatccagtccgctggccaaattcacactggcgttctgtgaaggttggctgggatgagtccactgcaggggagaggcagccaagagtttccttgtgggagattgaacctttgacaacattcccaatgtatccatctccattccccttaaggttgaggcgcccttggccatcgggcttaccttctttatatggtctcaaggatggagacatgggcattggttctccattcatgtggctccaaggtgggcttggggatcaaggaatgcaatctttaaacttccaggggcttggtgttacaccatggatgcaacctagacttgatccttctataccaggtctccagccagagttataccaagcaattacttcttctgcattccaggaaatgaggacaatggatctttcaaaatcttcgcaatctcttttgcagtttcagcagacttcaaatgttcccagtgctcatgcttctgaggtacagaggcaattgttaccacagtctcagcttcaaaacacccttctacacaattttcaagaaaaccaggtgcctgctcagtcacaacttctgcaacagcagttgcatcgttaccacccgtatagtgatcagcagcaacagcagcagcaacttaaaaacttgcctgttcagcagcagttaccaaatgtcatctctcctatgtctaagtttgcatcaggtacccagtctcaatctcctcccatgcaagccctagcttcacattgtcagcagcagagctttcctgaacctatgaggaatcatatttccggttctgatgtttcccctatccagagtctactagggtcattctcccaggatggaacatcccagttacttaacttgagtggatccaattctgttatgtcttctgctgccatactgcccaagcaaataactgccgagcctcctcagcttccatctgctgcttctcagtgcatattgcctcaggtggaaaacttgggaacatcacaatcaaatgtgtctgaacttgctgctttgcctccatttcctggaagagaacattctgcataccatggcgctgctgatcctcagagcaatcttttatttgggattaacattgatccctcttctcttatgctgcaaagtggcatgtcaaacctgagaaatataggcaaagtgaacgattcattatcgttgccattttctacttcgaattgtggtggtgctacaggcactgatttccccttgagttcaaacatgacaacttcaagttgtgtggatgaatcaggcttcttgcagtgttctgaaaatgtagaccaagcaaatataccaactggaacctttgttaaggttcacaagtcagggtcctttggcaggtcactggacatttccaagttcagcagctatgatgagctcattagtgagcttgctcgcatgtttggccttgaaggccaactagaggaccctaagactcagagatcaggctggcagcttgtatttgttgaccgggagaatgatgttcttcttcttggtgatgatccttggcaggagtttgtgaacaatgtgtggtacataaaaatactatctccactagaagtgcaacaaatgggcaaaggtcttagtccttctacttctgccccaggtaacaaactttctactcctgccaactcttgtgataattatgtgagtcaacaagagttgagaagttcgagaaatggcatggcatcaatgggatcttttcactactaggacactctcccatgtaaggaaatattagttgagaaattatggtggcagaattttatgttacaagttttcttatgtatggattggcccagcattcttgtacacattaatggttgacatgtagtgattttgcaaggtctaaatagatcaacagcaaatgactgtaaattataataggtggccttttttctgtaatggttagttgcttatagcagttattaattattactgtatcttaaaaaggccacacattaatggttgacatgtagtgattttgcaaggtctaaatagatcaacagcaaatgactgtaaattataataggtggccttttttctgtaatggttagttgcttatagcagttattaattattactgtaaaaaaaaaaaaaaaaaaag

SEQ ID NO: 176 - DNA, 1427 bp, Glycine max
  misc_feature (1327)..(1327): n is a, c, g, or t
atcaaaaacttcctctcctcagatcgttcctcttcgtctccttcaatcactcgtaagactcttccgagacggtgtgttcgctctttgattgaatggaaagtgaagacatgcattcgaaacctgacggtgggaatcagatcgtttcagagtcggttcatcatcactccataaatagtttaaacccttggcaacgtgctgctgctgcctgcaatgcaagttctttagtggaggaagctggagataagtctatagctttggagaaccaaaacaattgggaatcaactaatggttccaagtcaccatctcataaagatgaaaatggtaacaaggaatcaccacaagtcacatcctctccccaacaatcagctggagattacagtgaaaaaagtcaagaacttgtgcatgttggcgtcacaggacctcctcaccctcaacttgttagccacacaggatgggcatcctcaaatccataccaggatccttattatgctggaatgatgggagcctatcccatggcttatgttccatatggtgggatgcctcattcaagaatgccactgcctcctgaggtggcacaggaaccagtttatgtgaatgctaaacagtaccaggcgatacttaggcgaaggcaggcacgcgccaaggcagagcttgaaatgaagctaatcaaatccagaaagccttatctccatgaatctcggcatcagcatgctatgaggaggcctaggggcactggaggccggtttgcaaagaaaacaaacaccgaagtttcacagccgaaacctggagaaaagaacaatgctactcagtccccgacgtcatctcactctgaccaacctgaagcctggaatgatgagtgtagaaaacagtctgaagagatgcaaagctcagcttctaagagaagggaagaagcagactgttcagggcaacaatggaacagcatttcctcaaaccatacttctgaagctcgtctagccatcaaatgacatctccactggcaactcattcttggctctctctttgttggcttatttggtagcagccattgaagagtcccctgtacaaatacttctgtgtttttcttcttttgtgatatgtcaaatgttactgctttcttttgtcaactctctttagcacatttttgaatcaaaaactatgtgtttaaaattaaattccaaagtgtgcaaactgaaaaaaaaaaaaaaaaaaaaagcttattccaataaccgcccaacctcccagggggggccccggaaccccaatttccccctatatccgagccttaattactcttccgctccactgcccctctttttttaaacccctncccggactggggaaaaacctctgggggcctaccacaactttaaatccccattggcaagcacattccccccttttctcaccccttgggccgccaaaaaacc

SEQ ID NO: 177 - DNA, 1326 bp, Glycine max
aggattgtaccttccctccttcacaactgtgttacaaccaatcacttgtgagtagataactagatatgtgattgtgtcttagtggactgagattatttgtaaatctttttcttattattttacttctcaggctcatactgcattccactttgctgagccgtgctttagtggcctactagctgctccatttgtgccacaatctaatattcatcatgctcagctactaggaatgactcctgctcgaattcctctgccacttgatcttagtgaggagcccatgtatgtgaacgcaaagcagtaccatgctattctgagacgcaggcagtatcgtgcaaaactggaagcacagaacaaactcatcaaagaacggaaaccatatcttcatgagtcccgccatctacatgcactgaagagagctagaggttccggtggacgctttttgaatgccaaaaagctccaagagttgaaactcacttcagcaaaccgtggcctagatgtttctggctgtactcaattgaatctgagtggaaatatgtcagaatcaaaggttcaagcagtagaaaacttgaactacagaaatggtgcttctacaaccacgtgttctgatgtcattagtacatctaatagtgatgatgtcttccagcaacatgagtcagactttaggttatgtggttacccttctcatattggaaggaacatgcagggttattccgcagacattggtggtggtggtggtggtggaaatcaacaccgtctatcagtccttatgtgacaaacttttatggcacactagcaagttattcttcagcgctctgttggagatcataattgcctgtgttccatagggaagtcatccttggctcatttacattattatgtttttactaatatgtttatgttagttgttttggaacaaagatatagacctttgctagatttcaattttcttatattgatgactgaaatatttgggcaaagtagcacatttaactgactagtcacaagcaatatttcttttatgttgatgttacattggaaaatgtctttttgagaactaaggttttggttgtggtgtatgttttatctttgtacactgatgctttattaattttgagagaaaaaccttggctgctgttggtgtctttgctaaaatcatttgtgttaggtctttgtcgttttttgcttgggcttatatggttgataaagcctccacaacattttggtggtggataggtgttatgatagaagttgccacttgtgtgaaggtgccaatatcaaagcatcttttgctttgctaaatatcacttctcaattttgccttgcttc

SEQ ID NO: 178 - DNA, 1220 bp, Glycine max
gtctctcttgaggttgcagacttagagagagagagagataatgggtctcatttcaatgcaattcaggttctgaaaaccaaagcttttcataggaaaagttgtgctaagatgccggggaaagctgacactgatgattggcgagtagagcgcggtgagcagattcagtttcagtcttccatttactctcatcatcagccttggtggtgtggagtgggggaaaatgcctctaaatcatcttcagctgatcagttaaatggttcaatcgtgaatggtatcacgcagtctgagaccaatgataagtgaaggtgttgccaaagaataccaaaacatcaaacatgccgtgttgtcaaccccatttaccatggacaaacatcttgctccaaatccccagatggaacttgttggtcattcagttgttttaacatctccttattcagatgcacagcatggtcaaatcttgactacttacgggcaacaagttatgataaaccctcaattgtacggaatgtatcatgctagaatgcctttgccacctgaaatggaagaggagcctgtttatgtcaatgcaaagcagtatcatggtattttgaggcgaagacagtcacgtgctaaggctgagcttgaaaagaaagtaatcaaaaacaggaagccatacctccatgaatcccgtcaccttcatgccatgagaagggctagaggcaatggtggtcgctttctcaacaaaaagaagctcgaaaattacaattctgatgccacttcagacattgggcaaaatactggtgcaaacccctcaacaaactcacctaacactcaacatttgttcaccaacaatgagaatctaggctcatcaaatgcgtcacaagccacggttcaggacatgcacagagtggagagtttcaatattggttaccataatggaaatggtcttgcagaactgtaccattcacaagcaaatggaaaaaaggagggaaactgctttggtaaagagagggaccctaataatggggctttcaaatgacacttcgcccagccatacagcaacagttaggtgaagatgaagggtttttatctcatccaacttgtgatgctgtattgaaggcaattcattcttggcttagttaagtggtgagaccagtgacatggagtacactctgccttgtttggtctctccccttgcatttgtttctctttacaagtccatatgtaaaaatggataacgg

SEQ ID NO: 179 - DNA, 1359 bp, Glycine max
cgtaggccccccccccccaacaaagccatagaaatgaagaattagagagagtgagaggaggaagaagaagaagaagattccagaatccagagtgagaaacattaggcttatcagaggagacatgcccgagttgaaccgacaattctattactactctttgcttctttcttcatgcctcatcaaatcccaaaggatataattgaaggttttgggaacctaaggctgcaatattgtatacattctactcaaggaatggtcaagatctggaaatttgctatgtggaaaggttaaatgaagccattcttgttgagtcatcctgatactatgtacaattgttctcaagtttattgtagtcattcactggctcatacttcttatccttgtggtgatccttattttggtagttcaatagttgcttatggaacacaggctattactcaacaaatggtgccccagatgctgggattagcatccaccagaattgcattaccagttgagcttgcagaagatgggcccatttatgtcaatgccaaacaataccatggtatactgagaaggcgacagtcacgagcaaagcttaaagctcaaaacaaactcatcaaaagtcgtaagccatatcttcatgaattctcggcaccgccacgcattgaaaagggttaggggaactggggggcgctttcttagtgccaaacagcttcaacagtttaatgcagaacttgtcaccgatgcccattcaggcccgggccctgtcaatgtttatcaaaagaaagatgcatctgaggcagaaagtcatccctcaagaactggaaaaaatgcatctatcacattcacagcaatctctggcttgacaagtatgtccggtaacagtgtcagtttcaggcggcctgagcacaacttcttggggaactctcctaatataggtggatcgtcgcaatgcagtgggggactcacctttggtggtggagctcggcaatgtacttcagttggccggtgagaggtggaaccaatcaaaatcaagttcactggtctggcaaatcatccttggcttagtcactttactttctgtgtttcatgtgttgttacggaaatgttgtcttttggaagactctgcattagcactcagacttttgctagtgctttcccatgtattttgaaagttgctcttgtttctgttgttgaactggaccagaaagtttgtgcttgaaaatttaactttttatccgtcaaaaaaaaaaaaataaaaggtccaactcctataaaccaaaaccggagagaagaaaatgaaaatttgctcattactgacgtcaacatgtatttggatgaagtaaacacagaacattgaagttggttttcccgtac

SEQ ID NO: 180 - DNA, 1436 bp, Glycine max
ggaattcggcacgaggcattgtctctcttgaggttgcagacttagaaagagagagagagagagaatgggtctcatctcaatgcaatttaggttctgaaaaccaaagcttttcataggaaaagttgtgctaagatgccagggaaacctgacactgatgattggcgtgtagagcgtggggagcagattcagtttcagtcttccatttactctcatcatcagccttggtggcgcggagtgggggaaaatgcctctaaatcatcttcagatgatcagttaaatggttcaatcgtgaatggtatcacgcggtctgagaccaatgataagtcaggtgaaggtgttgccaaagaataccaaaacatcaaacatgccgtgttgtcaaccccatttaccatggacaaacatcttgctccaaatccccagatggaacttgttggtcattcagttgttttaacatctccttattcagatgcacagcatggtcaaatcttgactacttacgggcaacaagttatgataaaccctcaattgtacggaatgtatcatgctagaatgcctttgccacctgaaatggaagaggagcctgtttatgtcaatgcgaagcagtatcatggtattttgaggcgaagacagtcacgtgctaaggctgagattgaaaagaaagtaatcaaaaacaggaagccatacctccacgaatcccgtcaccttcatgcaatgagaagggcaagaggcaacggtggtcgctttctcaacacaaagaagcttgaaaataacaattctaattccacttcagacaaaggcaacaatactcgtgcaaacccctcaacaaactcgcctaacactcaacttttgttcaccaacaatttgaatctaggctcatcaaatgtttcacaagccacagttcagcacatgcacacagagcagagtttcactataggttaccataatggaaatggtcttacagcactataccgttcacaagcaaatgggaaaaaggagggaaactgctttggtaaagagagggaccctaatggggctttcaaataacacttccctcagccatacagcaacagttaggtgaagatgaagggctttatctcatccaacttgtgatgctgtatagaaggcaattcattcttggcttagttaagtggtgagaccagtgacatggtgtacactatggccttgtttggtctctcccttgcttttgtttctctctacaagtccatatgtaaaatggataacagaaagaaaaagaaaaatcactttggtttgagaactttttaaagtttatattaactgtgttaaggttcataaaactgtagactgatttgtgtgacatgctccacagaaccttaaattttcctctattttgtcctatatctccttgcacattattaatctaaattggtgcatattttctatagtaaaaaaaaaaa

SEQ ID NO: 181 - DNA, 1296 bp, Glycine max
gagtcattgtttttaagaccaagtagaagtcactttatgggtcaagacttagcactaaagccaagagaccaaaaagactaaaacaatgatggagtcattcaagtgttatgtttgagtgagagtcttttctaagcttacgaagtttcagggcagaagacatgcacagcttctgattcctctccaattcattcaacttccaaggtaggtggattattgttctaagaggtaggccttgagccagagtggaaaacaatgaattgcttatgtgagaaagactctggtctattttcttctcattcaacagctccctatgttcttggatgcccatcatgggcgacttctgaatttgaagtccaacgatcatctatgtccagaagtttgagctcaaaagtggatgttcttccacaacaatgccacaatagcaagacatttaattttcaattccaagaacaggatgcatcttcaaccaaatccactgatcaatcttatccagaagttggtcaaatttctgtccagcatagttctactgattcaacacttatcagaaatgaggggaagagtatgggatgtgtcatcaggtcatttatggggagtcaggatttccctttccctcctccactactggatcacagaccaatacttccagtggaaactgctcctgttcgaattcctcttcaattggattttgcagaagaacctatatacgtgaattcaaagcagtaccatgctattctgaggcgaagacagtatcgagcaaaactcgaagcgcttaacaaacccatcaaggatcggaaaccgtatcttcacgagtcccgccatcaacatgcactgaagagagctagaggcgctggtggacgctttctcaatacaaaaaaacaattacaatcaaatcatacacctgggaatattgcagaatcaaaaatgcatcacattgaaaactatagagatggtgctgatgtctcatatgcatttaacagtgatgcaagaaacatgcagaatgatgcagctgataagggtggtggcaccactcagcaacctctatttgtctacatgtgactaaactggcttgttgttgggcacatcactttgcttgtgttgtgttccattgggaagtcatccttggctcatcttttattatgtagttacgattattgctaattttgattttcgtcgacattgacatggacgtattgtataccctaaaattgtttgacactgacttgtcaaaaacaatgtttttctatgttaataccatatctgcaacatgtctaattgaaatgcgattatgtggcttcc

SEQ ID NO: 182 - DNA, 1733 bp, Glycine max
gaaaaattagagagtgagaagaggaagaagaacattctagagggagaaacattacacaactgaacccacaattctattactgtttgcttcaaaggatataattgaaggttttgagaactaaggctgcaatactgtatacattctactcaaggaatggtcaatatctggaaatttgctatgtggaaaggttaaatgaagccattcttgtcgaatcatactgattctatgtacaattgttcccaagttggttgtagtcatccaatgaatcaacaaatggtgccccagatgctgggattagcatccaccagaattgcattaccagttgagcttgcagaagatgggcccatttatgtcaatgccaaacaataccatggtatactgagaaggcgacagtcacgagcaaagcttaaggctcaaaacaaactcatcaaaagtcgtaaggtatgcttcacaaattacagttatacattattttgattcaccctgtttatcctaccttattcgtgtatggtcatgcattatattttgtggttttgggggggggggggttgtctttggaaagaatgttggtgaggaggaagagatgggcttggttggttgtatatgtatattttcacctgtttacctgctatggtgtaaaatataaaatgtagtttcattttctatataatttttcgtttttttatatactatacaattttaagttatttgagctatgacatgggagaaaaaaatgcacctgtttacctgttatagagtatttttttttctttctcgcttggataaataattaaatttagaatataagcctatacagctaaattacatgttaactacagtctagaagtgttatttatcattgcaagggagcattggaggaatcactctgaatattgaacttagaaatgaaccgtgatacagtagaataacaattacatgttgcattattctgtgaaatgttattattacatttagtcatatggcaaagctgtacagcctgctttcttgaatctgttttggaccaaaagaaatagtgttactccactgatttccctccctttctaattgattgcagccatatcttcatgagtctcggcaccgccacgcattgaaaagggttaggggaactggggggcgctttcttagtgccaaacagcttcaacagtttaatgcagaacttgtcaccgatgcccattcaggcccgggccctgtcaatgtttatcaaaagaaagatgcatctgaggcagaaagtcatccctcaagaactggaaaaaatgcatctatcacattcacagcaatctctggcttgacaagtatgtccggtaacagtgtcagtttcaggcggcctgagcacaacttcttggggaactctcctaatataggtggatcgtcgcaatgcagtgggggactcacctttggtggtggagctcggcaatgtacttcagttggccggtgagaggtggaaccaatcaaaatcaagttcactggtctggcaaatcatccttggcttagtcactttactttctgtgtttcatgtgttgttacggaaatgttgtcttttggaagactctgcattagcactcagacttttgctagtgctttcccatgtattttgaaagttgctcttgtttctgttgttgaactggaccccaaaaaaaaaaaaaaaaaaaaaaaaaaaaaaaaaaaaaaaaaaaaaaaaaaaaaaaaaaaaaaaaaaaaaaaagggcggccgc

SEQ ID NO: 183 - DNA, 1332 bp, Glycine max
aaggccggccgggcccgggaaaagccatagaaatgaaaaattagagagtgagaagaggaagaagaacattctagagggagaaacattacacaactgaacccacaattctattactgtttgcttcaaaggatataattgaaggttttgagaactaaggctgcaatactgtatacattctactcaaggaatggtcaatatctggaaatttgctatgtggaaaggttaaatgaagccattcttgtcgaatcatactgattctatgtacaattgttcccaagttggttgtagtcatccaatggctcatacttcttatccttgtggtgatccttattttggtagttcaatagttgcttatggaccacaggctattaatcaacaaatggtgccccagatgctgggattagcatccaccagaattgcattaccagttgatcttgcagaagatgggcccatttatgtcaatgccaaacaataccatggtatactgagaaggcgacagtcacgagcaaagcttgaagctcaaaacaaactcatcaaaagtcgtaagccatatcttcacgagtctcggcaccgccacgcattgaacagggttaggggatctgggggacgctttcttagcgccaaacagctgccacagtctaatgcagaactagtcactgatgcctatcaaaagaaagatgcatcagaggcagaaaatcatccctcaagcaccggtgaaaatgcatctatcacattcacagccatctctgccttaactagtatgtccagtaacagtgtcaatttccccaacatggctggatcatcgcaatgcagtgggggactcacctttggtgctggagctctccaatgtacttcagttggccgatgagaggtggaaccaatcaaaatcaacttcactgctctggcaaatcatccttggcttagtcactttactttctgtctttcatgtgctacagaaatgttgtcttttggaactgctttcccatggtttttgaagttgctcttgtttctattgttgaactggaccagaaagtttgtgcttgaaaatttaactttttttatctgtccgtgcatggtccttgcttttccaacgcctatagaacaaaaatggagtgaagaaaatgaaagtttgcacatcactgacatcaacaggtatctggatgaagtaaacacaacgtttaatttggtattaccgtacaaaaacactatgctagtgtttggtatagatgaataaaaaagaaagaaagtttaagaaatgaaaatagacgaaagagaaatgaaacagagaaaaatggagtaattcttcgatttgacacacattttgatgtgtct

SEQ ID NO: 184 - DNA, 1618 bp, Glycine max
gagatcccaaaggtactcttatagtacttcttctctttctctcactgtttttgttgcttattctgccttatcctgtctccctctcttcactacccttttttttttttcactttccttcttatcatctttttttcttttttggtttatattttgggggggtatttttcttttcatttgtacttttttatttattgatcttgggttttggtttattttattgtgtgtggaatacaagtggtgaagttagaaattttgttgtttcccatctgcatgtggagtttgaggtcagctttgtgtttgttaatcgaaaaatcaaacaaacaaagccttcaacaatcaaaagcaaagaagtgaagagagagagaaagagatcattctagagacagagagaaaaattagcttcagtagatattagtggtgggtttgggtttcaagagaggagacatgcctaacttgaacccaacacttcaagtacttgcttcttcatacccttaccagatcccaaaggtcttgatctaattttaagtgattcttctgatgactatattgaaggttacatgaagccatttctctttttaaatcttcccaacaccgagttcaattcttcacaagttgattgtaatcactcaatggctcattcttcttatccctacggcgatccaatttttgcttatggaccacaagctattagtcatccccaaatgatacccccgatgctgggactagcatccaccagagtggctttgccacttgatcttgcagaagatggaccaatttatgtcaatgcaaaacaataccatggtatactgagaaggcgtcagtcacgagcaaaacttgaggctcagaacaaacttatcaaaaatcgtaagccatatcttcacgagtctcggcaccgccatgctttgaatagggttaggggatccggggggcgatttctcagcaccaaacagcttgcacagtctaatgcagaatttgtcactggtgcacattctggttctgaccctaccaacagatatcaaaaggaacatctatcagaggtggaaagtcattcctcaaaagatggagataattcatctttcatcacaacctgctccgaccggccatgtttatctggcaacaatgtcaattttcggcagcaggagtgcatgtttctggggaattctgcaaacatgggtggatcaccacagttcagtgggggactcacctttggcggagcaaagcagcgcacatcagttgtccggtgagagaagaaactgatcgaaaccgacttcaccggtcaggcaaatcatccttggcttagtcacttttgtctgtgtctttatgtgttcgtactaaatgctcattttgagagacttttttcagtctgcattagcactataagacctttccaattgctttggcatgtattttaaagttgctattgtactggattttgaactggattggaatagtcttttgcatggaacttgtatgtttgtgttagttactgttgaatttccttgcttcaaaatatgtgatttctaatagtggattatttactcttttgggttaaaaaaaaaaaaaaaaactttccagatgattaatatctgctaaaaaatctggttgaatactttccgaa

SEQ ID NO: 185 - DNA, 718 bp, Glycine max
accaaccagtcaaacgagtgttggtacaccaagagtttttgtttctccatactccataatcttctgacctctgaccatccttccattccatgttggttgaagttgcctaaccactaaaaaactgtacaaaatgcaaaaatgagcaaagaacgaaggattgattgactgatttcaacagaaatcacagacaccaatcatcaatcattcttcccccccccccccccccctagtatcattcacaccacaaacacaagaacaaagccaagaatgatttgccgcttggcaagtactgcgatcgcgttaacgctttatcacgataccttctaccacatatcactaacaacatcaacactcatcactctcgacgacatccactcgatcactactctcacacgaccgattaactcctcatccacgcggccgcctgcaggagcgccaagcggcaaatcattcttggctttgttcttgtgtttgtggtgtgaatgatactaggggggggggggggggggaagaatgattgatgattggtgtctgtgatttctgttgaaatcagtcaatcaatccttcgttctttgctcatttttgcattttgtacagttttttagtggttaggcaacttcaaccaacatggaatggaaggatggtcagaggtcagaagattatggagtatggagaaacaaaaactcttggtgtaccaacactcgtttgactggtttag

SEQ ID NO: 186 - DNA, 1516 bp, Glycine max
cgtcaacctgtgtttcctccattcagtcggaagacaaatcactaacattctttcctcatgacaatttgtgctactcgtaagggaggctttcttttccttttacccttttcataggtgtatgaggtgggtgtggcttgccagctccctggtggagtgccttaggatctcaaccagtttacggggagtattgtggtcaaatgaagtccttttcattggagatttccaactatgtggaccaatttggtgctggtaagcaagcggcacgaggagttgagcaattgttggataaaggacatacaactcagtttaccatctttccagatgattgtaagatgtcaggtgatgcacaaaatcctcaggcaacattatcactgcaatcatcactggctgagccccacaatcgttttgagataggggttaatcagcctatgatctgtgcaaaatatccttatatggatcaattttatggactcttctcagcatatggacctcaaatttcgggacggataatgcttccaattaacttgacatccgatgaaggaccaacttacgtaaatgctaagcagtaccatggaattatcagacgtaggcaatcacgtgcaaaagccgtacttgagaacaaaatgataaaacgtcgcaagccttatatgcatgaatcacgccatctacatgcgatgcggcgaccaagaggatgcggtggtcgcttcttgaacacaaaaagctctactgatggaaatggtaaaaatgaaagcgaagtgattaaaaccagcggccgacaattccagtccagtgcctctcagagttctgaagtcctgcattctgaggttggaactttaaattcatcaaaggagacaaatcgaagcagtccaaacatctctggttcagaggtgactagcatgtattcaagggaaggttttgatggtttttctgtcaatcgtcttggatcttccgttcactccctagtggacatggtattatcacgcccactaaatgggttgcagcagtatcaggtaactgctgcaaccttaaagtttgattagcaacgagactagtgggcttggtgctgcgatgttgcagcaccaccctatccttgcaagggaccaggtgaggaacttctgttgcagtttcttgtgttcattgtgacgaatttcgttctggaggtgtgattcttcatctggttttaggcaaaccattcttggctactgcttaggcaactcatccttggctcattatattagtagtactgtctttttctttctgcacaggcttgtcatgacatggtcatacatgctaatggcttcatatcctgatgcagtagactatgatgtgtctgtttgtgttaaaataacaagaattctggtttcgtgtgttttttagttatgtctaggtgtggtattttgttctggttttctgacttcgtgtggagctatgtaacatagaactctggattgtgatctttgttagaaaaataaaacattgatctgacttaccctccgaaaaaaaaaaaaaaaaaaaa

SEQ ID NO: 187 - DNA, 1781 bp, Glycine max
tcagctacgtaggcccccccccgggactgactgtgggtgcgaaaaagagataactgtgtgacaggaagagagaaaaagaggaatcaagatagctcctttgaattttctatcagaatctgaggacccaaaatctagggttttctgttcttctctggggatctgaagacatgcagtccaagtctgaaactgcaaatcggctgaggtcagatcctcattcctttcaacctggcggtgtttattctgagccttggtggcgtggtattgggtacaatcccatggcccaaacaatggctggggcaaatgcgtccaattcgtcgtctcttgaatgccctaatggtgattctgaatccaatgaagagggccagtctttgtccaatagcgggatgaatgaggaagatgatgatgccactaaggattcgaagcctgctgctcctaatgaaacaggaaattatgagcaagaacagcaagggatgcagcatactgcatcatctgcaccatccatgcgtgaagaatgccttactcagacaccacagctggaacttgttggtcattcaattgcatgttctacaaatccttatcaggatccgtattatgggggcatgatggcagcttatggtcaccaacagttgggatatgctccttttataggaatgcctcatgccagaatgcctttgccccttgagatggctcaagaacctgtgtatgtgaatgccaaacagtaccaaggaattctgaggcgaagacaggctcgtgctaaagcagagcttgaaaggaagctcataaaatctagaaagccatatcttcatgaatctaggcatcagcatgctatgagaagggcaaggggtactggaggacgatttgcaaagaaaactgacggtgagggctcaaaccactcaggcaaggaaaaggataatggtactgattctgtcctatcatcacaatcaattagttcatctggttctgaacctttacattctgactctgccgaaacctggaattctcctaacatgcaacaagatgcaagagcatcaaaagtgcacaacaggttcaaagcaccctgttaccaaaatggcagtggctcctaccataatcataatggattgcaatcttcagtgtaccattcatcctcaggtgaaagactggaggaaagggattgttcaggtcagcaactgaaccacaattgatggggggttagaggccgaggttggtttgtatcctagtgacatttggtaaataccttggttatctgtaaacactcttggcaatatatgtgccaagcggcaaatcattcttggctttgttcttgtgtttgtggtgtgaatgatactagggggggggggggggaagaatgattgatgattggtgtctgtgatttctgttgaaatcagtcaatcaatccttcgttctttgctcatttttgcattttgtacagttttttagtggttaggcaacttcaaccaacatggaatggaaggatggtcagaggtcagaagattatggagtatggagaaacaaaaactcttggtgtaccaacactcgtttgactggtttatcttttgtgtagttcaaccggttgttaatgttaacgtaagacatcatagaataatgaaacatgctattacatcatttgttgccctttgttatttcagtttttagtattttattggttcttaagaaaattaattttccattgtctgtagcaaagatgaaaaggaaaagttttctcgtccatgactttgtttgccttgttgaagtggccatgggacaatcggccgaatatt

SEQ ID NO: 188 - DNA, 1107 bp, Glycine max
attcggctcgagatcaattttatggactcttctcagcttatgcacctcaaatttcgggacgtataatgctgccacttaacatgacatctgatgatgaaccaatttacgtaaatgctaagcagtaccatggaatcattagacgtcggcagtcccgtgccaaagctgtacttgatcacaaattgactaaacgtcgcaagccctatatgcacgaatcacgccatctccatgcaatgcggcgaccaagaggatgtgggggtcgcttcttgaacactaagaattctgttgacggaaatggtaaaattggaaatgaagtgcataaaactgttggtgaacaattgcagtctagtggctctcagagttctgaattccttcaatctgaggttggaacttttaattcatcaaaagagactaatggaagcagtccaaatatttctggttcagaggtgactagcatgtattcgcggggaggtcttgacagcttttctctcaatcatcttggatctgctgtccactcttttgcagacatgatagatggtgggcgcggtatgatcatacccaccaaatgggttgcagcagcaggtaactgctgcaaccttaaagtttgatttgcaaagaatcaagggtgggcttgctgtagcattgcaccaggcccatcctcgatgaggccagatgaagaagcttcgtttcagttgcgtgtgctgactgtgacaagtttcgctcggtaagatcgtcctcacatctggtctaggcaatccatccttggctcatactttggcaatccatccttggctcattgtaactgaaggcaactcatccttggcttgatgtacttgcagtaatttgtctttctgcacaggaatgttgttggcatggtacaaactaatgacttgatatcctgatgcagaagacaactatgtttctgtctttgtgtgaaaatgaaagcatgaaactctagttatgtgtgcttcgaataatgtctaaacgtggtgttgtattttgtatttctgacttcgaggaacaatgtattatagaaccttgttctgtggtctttgttagaaaaaataaagcattggtgtgtaaaaaaaaaaaaaaaaaaaaaaaaaaagg

SEQ ID NO: 189 - DNA, 1954 bp, Glycine max
gtacaaccccgggattttcttacttttttattctcactttgactcatgaatgaattcctttatcctcttacatcacaactgaagtgagatatcaacattcaacaccccaaattctagttatagagaaagctaagttctttgatttgccttccacccccttaatttccttaattgatcaattgggaaatttggtctttgggggattttgaggattagggttagtatttgcttgattggggaagtctttatgtaacctgagtggaatggttctgtgtctgcatgtgtgaattctggcaaggggcatttggttgctgggcactgaccaagagttgaaagattttatatttacctttaaacagctgcggctcctgctgaagatcaaggagctagggatctgaagataagatatgcaatccaaatcagctacgtaggccccccccccaaatcaactgaggtctgatccacattcctttacacctaacaatgcttattctgaaccctggtggcgaggtattcagtacaatcctgtcccccaagcaatgttaggagtgaatgcatctaattcatcttcacttgaacgccctaatggtgattcggaatccagtgaagaggatgatgatgccactaaagaatcacaacccactgctcctaatcaatcaggaaattatggacaggaccaccaagcgatgcaacattcttcatcatctgcacctttggtacgtgatgattgccttacacaggctccacaagtggaacttgttggccactcaattggatacactccttttataggaatgccccatgccagaatggctttgccccttgagatggctcaagagcctgtttatgtgaatgccaaacaataccaaggaattctgagacgaagacaggctcgtgctaaagcagagcttgaaaagaaattaataaaagtcagaaagccatatcttcatgaatcccggcatcagcatgctataagaagagcacgaggtaatggagggcgttttgcaaagaaaactgaagttgaggcttcaaaccacatgaacaaggaaaaggatatgggtactggccaggtcccattgtcacggtcaattagttcatctggttttggatcactaccctctgactctgctgagacctggaattctcctagtgtgcaacaagatgcaagaggatctcaagtgcatgagagatttgaagaacgcaactatgcaaatgttttgcagtcatcatctactttttgtttgcactcgggtgaaagagtggaggaaggggactgttcaggtcaacaacggggaagcatcttgtcagagcacacctcacagaggcgtcttgctattcagtaaaccactgcatgtgttgatgctgaggttggtatatataattgagtgaactagtaggttgagtaccttggctatctatctgtaaacattggcaatttgcatgcatgtcaagcggcaaatcattcttggctgggtttcagctgttcatgatatggggagaagaatgattgattgggccatcatacttgtgttgttgaagtctaccagtccttcattatatcctctttttcattttttctgtttttgtacagagatagtagttagcaaagtcaagccaacggattagaagacttgatgaaacaaactactgactcactttcctctggcggctttattttatgttactcaccggttattaatgcttaatatgagacatcatatgagagatttgctgcataattgtattcacatccaaatcgacattatcaatccttggttcttttctcatttttgcactttgtaaagttttatagtggttaggatggtcacttcagaagattatggagtatggtgagaaacaaactcttgatgtgccaacactcgtttgactggtttatctttgggtagttcaaccggttgttaatgttaacataagacatcataggataatcaaa

SEQ ID NO: 190 - DNA, 1092 bp, Glycine max
attcggctcgagaggaaattatggacaagaccaccaagcgttgcaacattcttcatcatctgcacctttggtgcgtgatgattgccttacacaggctccacaactggaacttgttggccactcaattggatacgctccttttataggaatgcctcatgccagaatggctttgccccttgagatggctcaagagcctgtttatgtgaatgccaaacaataccaaggaattctgagacgaagacaggctcgtgccaaagcagagcttgaaaagaaattaataaaagtcagaaagccttatcttcatgaatcccggcatcagcatgctataagaagagcacgaggtaatggagggcgttttgcaaagaaaactgaagttgaggcttcaaaccacatgaatgaggaaaaggatatgggtactggccaagtcccattgtcacggtcaattagttcatctggttttggatcactaccctctgattctgccgagacctggaattcgcctagtgtgcaacaaggtgcaagaggatctcaagtgcatgagagatttgaagaacgcaactatgcaaatgttttgcagtcatcatctacttcttgtttgcactcgggtgaaagagcggaggaaggggactgttcaggtcagcaacggggaagcatctcgtcggagcacacctcacagaggcgtcttgctattcagtaaaccattgcatggagtttgatgctgaggttggtatataattagtgtagtagtaggttgagtaccttggttatctatctgtaaacattggcaatttgcatgtcaagcggcaaatcattcttggctgtgtttctgctgttcatgatatggggagaagaatatgattgattggaccatcatacttgtgttgttgaaatcaacccgtccttcattaaattctctttttcattttgtacaaagatagtagtgagcaaagtcaagccaacgaatcagaagacttgatgaaaaaaactctttgctctactgactcgctttcctatggcggctttatttatgtaactcaccggttattaatgttaaataagagacatcttatgagaaaaaaaaaaaaaaaaagg

SEQ ID NO: 191 - DNA, 1731 bp, Glycine max
ggaattcggctcgaggtacgtaccgacatgactccaacctgatggggttaaacactgcttctgcgtaggattcgatgccgctactccttcttcagtttctacaactgagtttcatatctcctttctattgatgtttatgctgaagactgaataaaagtctgagaaagctgcttactacaaaccaacaagattaactaagaaatcatcttttgggacgatgcaaactgtttatcttaaagagcacgaaggaaatgcgcacaattttgtgggcacgttgtcttctgcagcttcagcaccctggtggagtgcttttggatctcaatctgttcatcagggagagtcttgtggccaagtgaaacccttttcattggagctgccaaactgcatagaccaacttgctgccactaagccactagcaagaggagctgaccaagtgttgggtaaagggcacataactcagtttacaatctttccagatgattgtaaaatgtcagatgatgcgcaaaagcttcagacaaccatgtcactgcagtcatcgcttactgatccacagtctcgttttgagatagggtttagtctgcccacgatatgtgcaaaatatccttatacggatcaattttatggactcttctcagcttatgcacctcaaatttcgggacgtataatgctgccacttaacatgacatctgatgatgaaccaatttacgtaaatgctaagcagtaccatggaatcattagacgtcggcagtcccgtgccaaagctgtacttgatcacaaattgactaaacgtcgcaagccctatatgcacgaatcacgccatctccatgcaatgcggcgaccaagaggatgtgggggtcgcttcttgaacactaagaattctgttgacggaaatggtaaaattggaaatgaagtgcataaaactgttggtgaacaattgcagtctagtggctctcagagttctgaattccttcaatctgaggttggaacttttaattcatcaaaagagactaatggaagcagtccaaatattttctggttcagaggtgactagcatgtattcgcggggaggtcttgacagcttttctctcaatcatcttggatctgctgtccactcttttgcagacatgatagatggtgggcgcggtatgatcatacccaccaaatgggttgcagcagcaggtaactgctgcaaccttaaagtttgatttgcaaagaatcaagggtgggcttgctgtagcattgcaccaggcccatcctcgatgaggccagatgaagaagcttcgtttcagttgcgtgtgctgactgtgacaagtttcgctcggtaagatcgtcctcacatctggtctaggcaatccatccttggctcatactttggcaatccatccttggctcattgtaactgaaggcaactcatccttggcttgatgtacttgcagtaatttgtctttctgcacaggaatgttgttggcatggtacaaactaatgacttgatatcctgatgcagaagacaactatgtttctgtctttgtgtgaaaatgaaagcatgaaactctagttatgtgtgcttcgaataatgtctaaacgtggtgttgtattttgtatttctgacttcgaggaacaatgtattatagaaccttgttctgtggtctttgttagaaaaaataaagcattggtgtgtttttctcctgttgagcaatgtcaaaattttatcatcctttacatttagaaaaa

SEQ ID NO: 192 - DNA, 2060 bp, Glycine max
gaattcggctcgagaggcccacaatcataacaaccaaaaagcccccttctccttccaacccctccattttcaacaacaattcctctaagcatcgttcagacaagggtacaccacaacagcttttgttagtcctcaccaagcgatgagagttcccgttccctcatccccacaggccaacccaaaacccaccaataacgttgtccgtaccattgcccttcccaacctcaacaatagcaccacgccccccacgggcctgtgctacgagcccacttctgtccttgacctgtgccggagcccgagcccgggcaccgaaaagcccaccaccgatcactccgttctcgtcaccaactcccaagactatctcgacctggaagaccatgcgttgcacaacttggactgggactccatcatgaaggacttgggcttacacgacgactccgccacccccgttttgaaaacttttctccaccccgacgacgacgacgacgacgacaacaacaacaacccatcatgcgacgacttcacactcttcgaccacgcgcttgaattcaccactctctccgacatctactccaaccaaaacttcgctttcgatttcaaccacttgcctcacgacttcaaccacctcaacggcttcgatttcatcgaagagctcatccgcgccgccgactgcttcgacaccaagcagttacacgtggcgcaactgatattggagcggctcaatcaacgactacgatcgcccgtcggaaaaccactccatcgcgcagcgttttacctcaaagaagctctccagagtcttctctccggttcgaaccggactccgaggatttcatccctggtggaaatcgtgcacagtatcagaaccttcaaggccttttcgggaatttcgccgatcccaatgttctcgatcttcaccaccaatcaaatagttctggatcacgcggcgagctccttcatgcacgtcatcgacttcgacatcggtcttgggatccaatacgcttccctaatgaaggagattgcggagaaggcggcggattcgccggtgctccgaatcaccgccgtcgttccggaagaatacgccgtcgagagcacgctcgtccgcgacaacctcgcgcagttcgccctagatctcaggatccgcgtgcaggtcgagttcgtgccgcttcgaaccttcgagaatctctccttcaaggccgtgaagttcgtcaacggggagaacaccgccgtgctcctgtcgccggcgatttttcgccacctcggcaacgccgccgcgttcctggcggacgtgcggaggatctcgccgagcgtggtggtttttgtggacggcgaggggtgtgcggagactgccacggcgtcggcggcgtcgttccggcgcggcgttgtgagcagtttggagtactactcgatgatgctggagtcgctggacgcgtcgacggtgggaggcggaggggagtgggtgaggagaatcgagatgatgcagcctgcggccgaagattttggcggcggtggagagtgcgtggcggcgggttccgccgtggagggaggcgttttacggcgccggaatgaggccggtgcagttaagccagtttgcggattttcaagcagagtgcctgttagcgaagtctcaaatcagaggatttcacgtggcaaaacgccagaacgaactggtgcttttctggcatgatagggccattgttgccacgtcagcatggcgctgttagaacatggagtgttattattggcagaggggattatgtaataatgtagtaattataataaactgcaacgaaagtaaatttaggttccaatttcgaagtccactacactcgttcaaactattgctatgatggaaaaaatctaggtatctttggcaaaaggaaaaggtggggagggggtggtagataagataaacttgtatttttctgtaccattttgttgtccttctttgttggatggactctttgttatcctgatgaactttactactggttttctaatcaaagggtttggcagattaaaaaaaaaaaaaaaaaaaaaaaaaaaaaaaaaagggcggccgc

SEQ ID NO: 193 - DNA, 2075 bp, Glycine max
gcactccctcagggtgtgtttctgcctcaacaacaacaacagcatcatccaccaatagagcctctggatgagaagctacaagttctcaatcctcagttcattttgaaccaaaatcaatctcagtttatgccaaacgcgggtttggttttgcctttgacatatggccaactgcaagaaaatcatcagcttctccctcagcctccggcgaaacgcctgaattgtggcccaaattatcaggttccaaagacaccctttttggactctggccaagagctgttacttcggaggcagcaacagcagctccaactgcttcctcaccatctgctgcagaggccatccatgttggtggcaccaaagcagaaaatggtgaactccggcagcgaagacttggcgacccatcagcttcaacaggctataactgaacagcttttcaaagctgcagagctgatcgatgccggtaatctggaactcgcgcatgggatattggcgcggctcaatcaccaactttctcccattgggaagccttttcagagggctgctttttatttcaaagaggccttgcaattacttctccatccaaatgccaacaacagttctttcaccttctcacccactggccttttgctcaagattggtgcttacaagtcattctcagaaatctcaccagttctgcagttcgccaatttcacttgtaaccaagcactgcttgaagctgtggaagggtttgatcgcattcacataatagattttgatattgggcttggtggacagtggtcttctttcatgcaagagttagcactcaggaatggcagtgcacctgaactcaagatcactgcatttgtgtcaccctcccaccatgatgaaattgagctcagtttctctcaggagagtttgaagcaatatgctggggagttacacatgtcctttgagcttgagattctgagccttgaatctttaaattctgcttcctggccccagccacttcgtgactgtgaagctgtagtggttaacatgcctattggctctttctcaaattacccatcatatctacctttggtccttcgctttgtgaagcagctcatgccaaaaattgtggttacattggatagaagttgtgatcgaactgatgcaccatttcctcagcatctgatttttgcacttcagtcttattcagggctgcttgagtcacttgatgcggttaatgttcacccagatgtccttcagatgattgagaagtattatcttcagccatcaatggagaagcttgtcttgggtcgacatggtttgcaggaaagagcacttccttggaaaaaccttctcttgtcatctgggttttcaccattgacctttagtaactttacagaatcccaggcagagtgtttggtgcagaggactcctagtaaggggttccatgttgagaagaggcagtcttcccttgttctttgctggcaaaggaaggatctcatctcagtttcaacttggagatgctaagcagagccattttgcacctttgaactaccaatttaattttaaattctaaagtgctacataacttacagcttctattgatctttcttgcttgaatttgccttgtctatggttctatgctaattgtctgtttttaggatttattattttcagttaaggaagggaagtgaacatattaattagcaactgaatgacgatttatgagcgtgatatgcagtgtattattataaataggggcattctatatatgcattttgtcctgttttaattgcctaaatttataaacttttcttgtatgttttacaagaaagtaacactaattaccctgtaaagttgaggctttgtttgatgactttgatccctgataagtctctctccctctctggcacatgttgtaagctcaatctggtctttgaaagctatatagttgtctaaggtatcactttaacagttccccgaactattcagtgtggaatgggatgggaattcttcagttagtttgctagttttcagcaattgcattacatgtacgttttgtctgcacacttttcacctagaaaaattcgtatggagccagattttttatg

SEQ ID NO: 194 - DNA, 3257 bp, Glycine max
ccacgcgtccggaagaatacattcattcatctcatggctttcttcttcttccctcatcacaccttcttcaactgtttcaatctcaacacgccacagaagtatcagatagaagaagaaaaaaacaagctttatttttagagggtgcccaagttgtttgttcttttgtttttcctgcagcactctatgtgtttgttcagtgttcctcgaagatttgtattgtccccaaaacaaaaacaaaaattcagcctttttagctcttccaacccgaaatttcttgttttttttatgtgttcttcatttggggtggtttaaatttgcttaatttgtaatcttttttttctggggtgggttgtggggaaataaaggtggtaccttttgaaaaactggagtcttttgggtggtgggttttgtggtcaccaattttattgttcttcccccccctaggcaactttcttagatgaaggtcatgcccttgccttttgaggaatttcaagggaagggagtgttggatttctcttcagcctcagattcattttcagtgcttttgcataacccacaaccaaagtggaccatagacaaagaggactattgctatgtgggcagcatcactgagcccacctcagttcttggctccagaagaagccttagccctcccacttcctcctccacaatgtcttcttctcttggcagcagcaacaacagcactagcaagggtggtggtggcacctcagccaacaccaccaacaacccaacaccaccctcagactacaacaacaacaaccctcctcaggaatccagccccgaaaaatgtggcatcaggatggaggactgggaktgccaagatcaatccatcctgaggctaatcatgggggatgttgaaracccttctgctggattgagcaagcttctgcaaagcactgcctgtggctctcaaagtgctgatttcaatgctggatttggtgttgtggatcaacaaggattgaatatgaatatgaatatgaatatggtgggtggtaatattgacccaaattaccctgctggtttccctttcattgctgagaatatggatggccagaatgccaaggctggttctgggactggccaggtttcagaatctgttgttttctctgccaacaatcctctcatggtgtcatcatctgtttcccctggtgtgttcacttctcagcagcagcagcaagagtttggagtggtggatgagaagcctcaggttattaatccacagtttatgttgaaccagaaccaagttcagttctcagataacccttctttctttttgccattgatgtacccccaggtgcaggtgcaggagcaacaggttttctctcctccgcatcaatcgaaacgccctctctttgacacgattggtcacaattttcaggctccaaggttgccccttttggattcagggcaagaggtgtttggtaggaggcagcaaacacagctgccattgtttcctcaccatatgcaacaacaacaacaacaacaacaatcaatgggtttgccatctgctaaacagcagaagggtgagttccaccggagacgatgcaagccaccagcttcagcaggctatatttgatcagttatacaaaactgctgagctgatagaagctggtaatcccgttcatgcgcaagggatattgggcgcggctcaatcaccagctctcccctattggtaggccttttcagagggctgctttctacatgaaggaggccttgatgtcactgcttcattcaaatgctcacagtttcatggctttttcgccaattagtttcatttttaaaattggagcttataagtccttttctgagatatcacctgttcttcagtttgccaattttacttgcaaccaagccctcattgaagctgtggaaaggtctgacagaattcatgttatcgatttcgatattgggtttggagtgcagtggtcatcttttatgcaagagattgccttgagaagtagtggtgcaccttcactcaaagtcactgccattgtgtcaccctccacttgtgatgaggttgagctcaatttcactagagagaatttgattcaatacgcgaaagacatcaatgtgtcatttgaattcaatgttttgagcattgaatccttgaactctccttcctgtccactgcttggtaaattctttgataatgaggcaattgtggtgaatatgccagtctcaagtttcacaaactatccatcattgttcccttccgttcttcactttgtgaagcaactcaggccaaaagttgtggtcactttggacagaatttgtgatcaaatggatgtaccacttcctaccaacgtagtccatgttctccaatgttattcggccctgcttgaatcgttggatgcggtgaatgtgaatcttgatgtcctccaaaagattgagaggcatttcatccagccagctatcaagaaaattatacttggccaccaccattttcaagaaaaattacccccatgggaggaacctctttatgcaatctggattctctccattcacatttagcaacttcacagaagctcaagctgagtgtctagttcagagggcacctgtgaggggatttcatgtggagagaaagccttcatcacttgttctatgctggcagaagaaagaactcatctcagtttctacttggagatgctgaggactgaggagcagcagcagaagctaattaccttatatttttaaaggtgcatggtaacttacattgcagtttatgtaattgtttgtgtaatttaggcttattgatgagatccacacccaaatgttttcttaactgcatgggttggaatctaccattctgtagttctaatatttactagtatgtcactttgaacatgggtagtaattatgcctttccccattcccatcatctaaagatgggtaactgtttctttgttatcttgaacacaaagcaaattgcttagtaagaaacgaacaatttagctaagaatgcagcctctattttcttcttcttggtttattatattctttcttaattaatgtatgatgacctgaatttgggatacgtgattttaatatgcagcatgaaaatcttgtgccaattcaattatccaaatattagtttttgcgtggtttgagtgaaaagctggaaagattataattggttcatttgtagtctttaaggaaagacacccaaaacaaactcatgtatagtacttttgtttgtaatttaagaatataattcgttgtttgagtgttgatttata

SEQ ID NO: 195 - DNA, 3691 bp, Glycine max
aaagatctcaattgaatgaggatgcatagtgcactagcttatttttcaaaggagacagtagggttaggtcagtgtgtgtaagctgtctctctcttctctttgtaccctatatatatgccattcaaaagcaattaatgtgatgagaaagcgagagaaggcccaagtgatctttgtcaatgatattcagagcttgtttgatgtaatcatgaaggttatagcccccaagcaaaccagccatgacatgattgcacatgtaggtaaggcttgggctgcagtggaagagatgaaaaggttccttgtggctaattcattggaagaggtgaataggaaactggacaagttttatatggttctcatctggaggagtctacactcagactttgatcatgtgcgtgatcaagttcttgctggagatcaagtttcaccaatggattccctcatcactagacttcttcgtgtgcctcatgcattgaaggatgaaaatcttactgatgctatggaaacttcagctatgattgcaccttgtgggagaggaggaggccgcaacaacagaggaggccacagtggaaggggtggacgtcctcattgcacctattgcaagaggatgagtcacactcaggaaaactgttattcattgcatgactttcctgacaaagtagcacagttgtctaagttagagaaatcggagtctaggttctctgatgaagaatatcaggagtatttgaagctcaaatctgagaagtccagcaaccaagtacaatctttatttgtaccaggtttttcaacaacatgtatttctcaatccattgaaagtctcagactcagtccttggatacttgactcaggtgcctctgatcatatctctggtaataagtcttccttctcatccatttctttttcaaaaattcctcaccttgttactgtagctaatggctccaaagttgcgtctcaaggaagtggtcaagtttcattatctcccttattgaaattgaattttgtattatttgttcctcagtgtccatataatctaatctcattaagtcagttaactcgctcattaaattgctcagtaacctttactgcgaaatcttttgttattcaggaacatgggacgggtcgattgattggagaaggacgtgaatcacgaggactttattacttagaatccaactttcctgtttcctgtgtcctgttttgcaacttcaaaacccaaaactgaaaatgatggtccctagtcttaagaatcttagagtcttagaatgtgagtcttgtcagttaggaaaacatgttaggtcatcatttcctcaaactgtacaaagatgtaactcggctttctctaccattcattatgatatttggggaccaagtcgtgttacatcttttggttttcgatattttttaacctttattgatgaattctccagatgtacttaggtttatttaatgaaagacagatctgaacttttgcctatatttgtgtcgttctttaatgagattgagaatcaatttggcaaaacaattaagattttcagaagtgataatgctaaagggtatttttcctcatgacccattatttcatgtttctcctaaagtgtttggttgtacttgttttgtccatgatctttctcctggtttagacaaactttctgttaggtcaatcaaatgtgtctttttgggttattctcgtcttcaaaaaggttacaagtgctactctccaaccacaaaacgatactacatgtctgccgatgtaaccttctttgaagatacaccctttttctcaccttccatgaaccattccccttctctccaggaagttcttccaattccttctccttgtcctctaggtaactcaaaccaaaatgttagtgttgtcccatcttctccactaaattcacctgaagttgcttctccacctctcattacatatcaacacaggacaaggcaagttggatctacagtgcctgaagcttcttctcgtgatcctcatccatcttcaaccagtcctcaacccaattggcccattgtcatcaggaaaggtactcgctctactcgtaatcctcatcctatttataatttcttaagttatcaccgtttgtctccttcatatgcttcctttgttttctcattatcttcccttactattccttccaatgtccatgagacacttgatcatcctggctgacgacagactataattgatgaaatggaggctcttgaaaataatggtacttgggaacttgttcctctttctactgttaaagttgggcccaatggtgaggttgatcggcttaaggctcgcttggtagctaaaggctacacacagatatatgatcttgattattgtgataccttttctcctgtagccaaaatcacctctgttcgtctgtttcttgctatgactgccatgcgtcactggcctctccatcagcttgatattaaaaatgccttcctccatggtgatcttgacgaggatatttatatggagcaacctcctgggtttgttgctcagggggagtatggtcatgtgtgtaagcttcaccgatctctctatgggttgaagcaatctcctcaagcttggtttggtaactttagtcatgttgttcaactttttgggctgaaacaaagtaaagccgatcattctgtttttttattgtcatacatcccttggaaagtgtatttatctaatggtctatgatgatgatatagtgatattaggaaatgatgctactaagattgttcagctaaaagagcacttattcagccatttccagaccaaagacctgggatatctgaagtatttccttggtattgaggtggctcaatcaggagatggtgttgtgatctctcaaaggaagtatgctctggatattctgaaagaaataggcatgcaaaattgtagacctgttgataatcctatggacccaaatctgaagctcatggcaaatcagagtgatatctatcctgaccccgagaggtataggagacttgtgggaaaactcatttatctcaccattacaagacctgatatctcctttgctgttggagtagttagccaattcatgcaaaatcctcatattgatcattggaatgcagtcgtgcatattcttagatatgttaagagagctcttggacaaggattgttgtatgaggacaagggaaatacacaactatcggggtattgtgatgcaaattgggctgttgtcccatggataggagatccacatcaggttattgtgtcttcattggagggaatcttatctcttggaagagcaagaagcaaactgttgttgcttggtccagtgcagaagttgaatatcgatctatgactatgattacatgtgagcttatgtggattaaacaatttctccaggaattgagattatgtgaagttgtgcaaatgaggttatactgtgataatcaggctgctctccacattgcttctaattcagtctttcatgagaggactaagcacatcgagattgattgtcatttcattcgggagaaactattgtccaaggagattgtcactgagttcattaattctaatgatcaactagcagatatttcagtctatatgtctcaagcttggtgcatatgatttatatgctccaacttaagggggagtgttgaatatttgctttatttcaaatctgatgaaaaagccaaatgtagttattattatgtacacatt

SEQ ID NO: 196 - DNA, 2035 bp, Glycine max
ttcataagctatcacagtatgtctccttcatacagttcatatatttgttcatagtcttcccttgccattccttccactgtccgtgaggcacttgatcatcctggctggagacaggctatgattgatgaaatgcaggcccttgaaaataatggtacttgggagcttgttcctcttccccctggtaagacccctgtgggttgtaggtgggtctacactgttaaagttgggcccactggtgaggttgatcggcttaaggctcgtttggtagctaaaggctacacacaggtatatggcattgattactgtgatactttctctcctgttcagctacgtaggcccccccccccgttttttgctatggctgccatgcgtcattggctcctccatcagcttgacattaaaaatgccttccttcatagtgaccttgaggaggaaatttatatggagcaacctcctaggtttgttgctttgggggagtatggtcttgtgtgtaagctacatcgatctctctatgggttgaagcaatctccttgagcttggtttggtaaatttagtcatattgttcaactttttgggctgaaacgaagtgaagccgatcattctattttttactgtcatacatcccctggaaagtgtgtttatctaatggtctatgttgatgatatagtgattacagggaatgatgcttctaagattgtccagctaaaagagcacttatttagccatttccagaccaaaggcccagaatatctgaagtatttccttggtattgaggtggctcaatcaggagatggtgttgtgatctctcaaaggaagtatgctcatggcagatcaaagtgaagtttatcctaaccccgagagatataggagacttgtggggaaactcatttatctcacaattacaagacttgatatttcctttgttgttggagtggttagccaatttatgcaaaatcctcttgttgatcattggaatgctgttatgcgtattcttagatatgtaaagagagctcccggacaaggattgttgtatgaagacaagggtaacacacaagtatctgggtattgtgatgcagattgggctggttgtcccatggataggagatctacatcaggatatcgtgtctccattagaggaaatgttatctcttggaaaagtaagaagcaagctgttattgctcgatctagtgcagaggctgaatgccgatctatgactatggttacatatgaacttatgtggattaaacaaattctccaagaattgagattctgtgaagtggtgcaaatgaagttatactgtgataattaggctgctcttcacattgcttcaaacccagtcttccatgagaggactaagcacatagagattgattgtcatttcattcgggagaaactattgtctaaggagattgtcattgagttcattaattctaatgatcagttaacagatattttaactaagtccttaagaggatctaggattcagtctatatgttccaagcttggtgcatatgatttatatgctccagcttgagggggagtgttaaatatatgtgtagttttgtgtattgtttaattattcagctttattcagaggacaacaatgttaggtcaatgtaatcagctgtctctctcctcctttttgtatcctatatatatgttatttgaaagtaataaagcaagttgtctgtgagtaacaatttctctcacattcaaacttcaacttgttcattgtaagagttatacttagtcattcttagttaaatttctaacagaatgtggtagagataggctatagatcgggagagaagattagagacattctttatagtaagagattggtcttggaccctcaaaatactaagaacataccagaattttgttgtttttagtgttagaaaaccctaaatagattaagagactattggatgatgttcttcagtcttgtgagttgggatactattatctattggtaatgaaagcaaacaagtcaaaaaccagaaaataagttgaaatacaaaaaaaaaaaaaaaaa

SEQ ID NO: 197 - DNA, 2391 bp, Glycine max
atggcttcttccggtcctgttttttcattctctggaactcccaccattactactgccaaactcaactggaaaaactatatgtcttggtctgcttccgtggagttatggtttctcggccaaagatatcatgatcacttggaaaagggagttgatgctgttccgaatgacaggagagctgaatgggaaaagctggattttcagttgtgtgcagtgctatggcaatctgttgaatcggatgttttggagatccttagatcattcaaaacatgttgctctttttggaagaaagcacaagagatatttgccaacgacattcaaacagtggaagaactgaagagatttcttgcagcaaaatcgttggaggaagtgaataggaagctggacaagttctacatggtccttatcttgagaagtctacatttagattttgataatgtgcgtgatcaaattcttgcaggtgaccaagtcccgtcaatggactccctcattactagacttcttcgcgtgcctcaagccttgaaagaagaaaatttagctgaaagtgtggaaacatcagctatggttgcatctcgtggaagagaaggaggtcgcaacaatagaggagactgtggtggaaggagtggacctcaggtagctcagaccgaaaaatcagagcctaagttctctgatacagagtatcaggagtatctaaagctgaaatccgagaaatccagcagtcaggcttcatcttcctctgtaccatgttattcaacaacatgtatttttcaatctattgacggtctcagtccttggatacttgattcagctaatggttccaaagttgtagctcaaggaagtgatgtaaccttctttgaagacacacctttcttttcatcatctatggaccattcttcttccatccaaaatgttcttccgattccctctccatgtcctctaggtaccttaaaccaagatgtcagtgaagttccatcttctccaccacatccacctgaagttgctcctccacctcttcttacatatcaacgcaggacacagccagttggttctacagtatctgaagcttctcctcctgattctcatccttcttcaatcaatcctcaagccatggatcctgctacttctcatccctctgattcagactggcccattgccatccgcaaaggtactagatcctcttgtaatcctcaccctatctataactttctaagctatcatcgtttgtctccttcatattcttcctttgttttctctctatcttcgcattttgtcccttctaatattcatgaggcactgagtcatcctggatggcgacaggctatgattgatgaaatgctcttgaacatagtgattgatggacttaaggctcgcttagtggctaaaggttatactcaggtatatggccttgattattgtgatactttctctccaatcgctaagatcactactgaagagatctacatggagcaacctcctgggtttgttgctcagggggagtatggtcttgtgtgtaagctgcgtcgatccctctatgggttgaagcaatccccttgggctttgtttgtatatgttgatgatatagtgattacagggaatgatgctactaagattgtccagctaaaggagcacttattcagtcatttccagaccaaagacctagggtatttgaagtacttctttggtattgaggtggctcaatcaggagatggtgttgagacaagcatgcagaattgtagacctgttgatagccctatggatccgaatctgaagctcatggcagatcaaggtgaaatctatcatgaccccgaaagatataggagacttgtgggaaaactaatttatctcaccattacaagacctgatatttcctttgctgttggagtagtgagccaatttatgcaatatccccgtgttgatcattggaatgctgttacatgtattcttagatatataaagagagctccgggacaaggactgctttatgaagacaaaggtaacacacaaatatctgggtattgtgatgcagattgggctggctgtcccatggataggagatccacatcaggatactgcgtctctattggcggaaatgttatctcttggaaaagtaagaagcaagctgttgttgctcgatctagtgcggaggctgaatacagatctatggctatggctgctcttcacattgcttcaaacccagtcttccatgagaggaccaagcacatagagattgactgtcactttattcgagagaagctactgtccaaagagattgtcactgagttcattaattctaatgatcagccagctgatattttgactaagtctttaagggggcctaagattcagtttatatgttccaagcttggtgcatatgatttatatgctccaacttga

SEQ ID NO: 198 - DNA, 1458 bp, Glycine max
atgttagatcttaatctcaatgcggagtggaccgattcgtttagtaacggtgagtcgccgttaccgttagagaagtttccagacggtttgaggaaccaaatggccgagtcagggacttcgaattcctccgtggtgaatgcggacgggtccagtaacggcggcggcgacgaggactcggactccacacgagctgctgatgacgtgtacaccactttcaatttcgatatccttaaagtcgaaggcgcgaacggcttcgtaacgaaggagctctttccggtgatgagtgaaggagctaaaggacacgctacgtcgtcgttttcagggacgaatggtttcgtggatctctcgttcgatggcgatggagggaacactagtgagatgaagatgcttcagcctcagaatcagaatcagactcaaacgcgaactcagacacagcaaccagcgaaaaagagtaggagaggaccgaggtctcgaagctcgcaatacagaggggttactttttacagaaggacgggaagatgggaatcgcatatctgggattgcgggaaacaagtctatttgggtggatttgacacggctcatgctgctgccagagcctatgatcgagccgctattaagttcaggggagttgatgctgatatcaatttcaatctgagtgattatgaggatgaccttaaacagatgcagaatttgtccaaggaggaattcgtacatatactgcgtcgccaaagtactggtttctcaagaggaagctctaaataccgaggagtaacactccacaagtgtggccggtgggaagctcgaatgggacaatttcttggcaaaaagtatatatatcttggactattcgacagcgaagtagaagctgcaagggcttatgacaaggcagctatcaaatgcaacggaagggaagcagtgaccaactttgagccaagtacttatgaaggagagctgaaatctgcagccattaatgaaggaggcagtcagaatcttgatctcaatttgggcatagcaaccccaggacctcccaaagaaaattgggggcaacttcagttcccctccttcccttacaatacacatggtggaagaagttcaatgatggaaaccaatgttagttctggaattggtaatccatctttgaaaaggatggttgcaactgaagatcgtccttcattatggaatggcatgtctcctaatttctttcccaatggggaaagagcagagagaatcggcgttgatccttcaaacggactccccaactgggcgtggcaaacacatggccaggtcaatgctaccccagtaccaacgttctctgctgcagcatcatcaggattctcaatttcagctacctttccatcggctgccatctttccaacaagttctatgaactcaattccccagagtctctgttttacttcatccagcatgcctacccgcaatgcatctgaatattattac

SEQ ID NO: 199 - DNA, 2124 bp, Glycine max
actttatgttccttttggatcctctcacatctctctttctttctccggtgtcatggaatccggtagtgcccgatgtttatattccctccggttctgaaatcatcaaatgcaactaccaaacctcgagaagcttccttcacacacttccttcttttccttgttcttcgaacaagctctttctcattccatcaccacaacttccgatattgcatcttcaactgttttggttacattttacgcgtaataactgattgtttctttcgattggaaccatcgctcgaagagaatctccggtgacgtcgaagcaatattagtttactgtatgtattagttcggattaataataataaagcgcataagtgataacaacaacaaaaaaagaatatctgagttgaaaaattgctagaagaagattaaacgcgatgttggatcttaatctgactgccgagtcgactcagaacgacgagttgctggtgctgttggacaagtttcctgaagcttcgtcgggaacttcgaattcctccatcgtgaatgcggaggggtcgagcaacgaggactcgtgctccacacgcgccggcgacgtgttcaccttcaatttcggaatccttaaggtggaagccgcgaatgacgtcgttgccgcggcgacgaaggagctgtttccggtgagctcggagaattggcaggggcagagttcgacgtcgttgtttcaggcgaggaagagtttgatggatctctcactagatcaacaacacggggaggtgaaggtggtacaggttcagccacagcctaaggtgaagaagagtaggagaggtccacggtctcggagctctcagtacagaggagtcaccttctaccgaagaaccggaagatgggaatcgcatatctgggattgcgggaaacaagtctatttgggtggatttgacaccgctcatgctgctgctagggcctatgatcgagctgctattaaattcaggggacttgatgctgacatcaattttaatctcgttgattatgaggaggatctaaaacagatgaagaatctttccaaggaggagttcgtgcacatactccgccgccacagttccggtttctcaagggggagttcgaaataccggggagtgacacttcacaaatgtggccgttgggaagctcgaatgggacaattccttgggaaaaaggcttatgacaaggcagctatcaagtgcaatggaagagaggctgtgactaactttgagccaagtacatatgagagcgagatgaaacccgaagctattaatgaaggtggcagtcacgaccttgacctcagtctgggcatagcgaccccaggacatggtcccaaagaaaacagggggcatcttcagttccagtccatcccttacaacatgcatcctggaagaagttcaatgatggagactaatattaattccgttattggtgatccttctttgaaaagactggttgtaactgaagagcgtccttctgtgtggaatgccgcatattccactttctttcccaatctggaaagagcagagagaatgggcacagatccttcaaaaggagtcccaaaccccaactgggcgtggcaaacacatggccaggttactgacaccccagtaccaccgttctctactgcagcatcatcaggattctcaatttcagccacttttccatcaactgccatctttccaacaaaatccatcaactcagttccccatagcctctgtttcacttcacccagcacaccaggtagcaacgcacctcaattctataactattacgaggtgaagtccccgcagccaccgtcctagcctatcttgtaatacaagtacaaatggttaatcgaaacaaccttttgcgcttaaaactcatcgtataattctgttactgattgatgtatacttagatacgacatctgattgcacttcttggtttaacaaaccattatgcacaaatgatgtatgaaggaaaaagctctttttgagtgctccagttctcttaggattattttttcatcaaaattagtatcaagttgtcagaattcgtgtattcacccaccaattttgtgaatatatgcctttgtgtatgcaaccctgaaaatgggaggaaacaaaaaaaaaaaaaaaa

SEQ ID NO: 200 - DNA, 1932 bp, Glycine max
atctctgagtcagtctcagccaggtacttgtttgtgccttattccctctgattctggaacaagttcccgttctttcttatctttctccactgttttattttctccctgatcttcctctaccttaatttcagtcctatttgttcttctgacagatactcttttaccttcaccagctcattcttcttctatcttcttctgctatatatgctcaacctttaaagggtatttctctctctctctctcaactagtttgagtttcattgtactttgatatcactgcagaagtacatgagactcttaaaagagggtatgctttaaagaccagaatcagaagctgattaaaggagagaacctttccaagacatggctatgtttgatctcaatgttgacatcaaccactgtgatgctgatgctgactcaagctgtgatcaaaagggattggtgctgcaaagtttcccacctgaaatctcagattccaggacctccagctcctctgtgtggaaccctgtagaggaagattcctcaaacaattcctctcccttgatttttgacatactcaagaaagagagggatgagtcagagtttgatgcagccactgaaagggtcaataaggagcaaaacatggcaccacaagaggcagagatagtggcaaggacacttttccctgtgactgctgctgttgataaaggagttagagtgcctgatttcaaattggggctgtgggggaagactgaatgcttgaacttgtccttaccagagcctgatggacaaaatggactcagaaccttacagcagaaggtacctcctgtgaggaaaaataggagaggaccaaggtctcgcagctcgcagtaccggggtgtcaccttctaccgcaggactggtagatgggagtcacatatttgggattgtgggaagcaggtttatttgggtggatttgacactgctcaagctgctgcaagagcatatgatagggctgctataaagtttcgtggagtagatgctgatataaactttagtttgagtgattatgaggaggatttgaagcagatgagaaatttgagtaaggaagagtttgtgctcttacttcgtcgacaaataaatggaatctctaggagaagttcaacatacagaggtgcattagcccttcgcaaagatgctcaaggagaaccacgaatgggaccatttgttggcatgacatgttatcctaagccatccatcaattgtgatgatggaaaagcggaggcaagttttaagccctgttcctataagggagaaataattgtgaattccaacatgacaggcacttgccataatcttgatttgagcctaggaatttctccgtcttctaaaagattgaagaataatgactatagtggagggtattcctttggatgtatgacttgtaagatacccgaggaaagaggaccaatggagaaggtcatggtggacagaataaaaaatgttcctttgcaaaaaatttccaacttggcttggcaactttgcagcaatggcagcattgtcccaaggccattccaaccaaatgcagcatcatcaggattcgtctcttcttctagctgtctcatcacccgcacttccaatcagcacacatattaattatgccaacaatttggcattaattggctcaaccacagtactactactagttgaaaccaccagaaacaaagcatatttaccctgcttttttgaagattagatgagcaagagtacttcataaccacatgtacctatagtataagattctattgatttcatcaagcatgatggtatttaataatattgctaagcattgcttacaatggctacccgatattttctgtattcattatcgtgatgtagaacacaatattgccttgtgtaaaagacccttgttgaagtatgtatatatttgttggttcttgttaatcattagct

SEQ ID NO: 201 - DNA, 2248 bp, Glycine max
aatgttttcttctcttctctctctctctctctctctctcttccatggaatccaatagtcggcgacgctttcactctctccggcgacgatgaactcatcgccgacgaaatgagtttgcgccggtttcttctctctcctcgttccgtgagttccttcctctcactccttctccgttctccggtcgccggaaaatttatccggtgttagcgatacggaaaactcatcgcgattccgttttcttcttcgcttcgttttctacttctctttatctttcacttacattacctctctcattcggttgtttccgatcggatccatttcgccgtcgccggcgaagttagttggaacaggctttagctaagttgtaaacctcagaaattataaaaatagataatcggaatttagtagttagttcggtttttagttacttaaccgcttaacgatataaataaataaataaaaagaagcgcgacgatgttagatcttaatctcaatgcggagtggaccgattcgtttagtaacggtgagtcgccgttaccgttagagaagtttccagacggtttgaggaaccaaatggccgagtcagggacttcgaattcctccgtggtgaatgcggacgggtccagtaacggcggcggcgacgaggactcggactccacacgagctgctgatgacgtgtacaccactttcaatttcgatatccttaaagtcgaaggcgcgaacggcttcgtaacgaaggagctctttccggtgatgagtgaaggagctaaaggacacgctacgtcgtcgttttcagggacgaatggtttcgtggatctctcgttcgatggcgatggagggaacactagtgagatgaagatgcttcagcctcagaatcagaatcagactcaaacgcgaactcagacacagcaaccagcgaaaaagagtaggagaggaccgaggtctcgaagctcgcaatacagaggggttactttttacagaaggacgggaagatgggaatcgcatatctgggattgcgggaaacaagtctatttgggtggatttgacacggctcatgctgctgccagagcctatgatcgagccgctattaagttcaggggagttgatgctgatatcaatttcaatctgagtgattatgaggatgaccttaaacagatgcagaatttgtccaaggaggaattcgtacatatactgcgtcgccaaagtactggtttctcaagaggaagctctaaataccgaggagtaacactccacaagtgtggccggtgggaagctcgaatgggacaatttcttggcaaaaagtatatatatcttggactattcgacagcgaagtagaagctgcaagggcttatgacaaggcagctatcaaatgcaacggaagggaagcagtgaccaactttgagccaagtacttatgaaggagagctgaaatctgcagccattaatgaaggaggcagtcagaatcttgatctcaatttgggcatagcaaccccaggacctcccaaagaaaattgggggcaacttcagttcccctccttcccttacaatacacatggtggaagaagttcaatgatggaaaccaatgttagttctggaattggtaatccatctttgaaaaggatggttgcaactgaagatcgtccttcattatggaatggcatgtctcctaatttctttcccaatggggaaagagcagagagaatcggcgttgatccttcaaacggactccccaactgggcgtggcaaacacatggccaggtcaatgctaccccagtaccaacgttctctgctgcagcatcatcaggattctcaatttcagctacctttccatcggctgccatctttccaacaagttctatgaactcaattccccagagtctctgttttacttcatccagcatgcctacccgcaatgcatctgaatattattactaggttaagcccccacaggcaccaccatagctgattttgcagtacagattaaagacaaactaaaacaaaagtgttttcggtccaaattctttttataattcagccactgattggtgtatactgagattcgacaccttattgctgtctcttgcttaaactataatgccccatgtttggatacatcatctttgaagcaaatgctatttttagtgcactagcacagcgatgtttctgttttcctcaaatttgttggcagtcaagattcatggtttgcatgccaaaaaaaaaaaaaaaaaaaaagaaaaaaaaaaaaaaaa

SEQ ID NO: 202 - DNA, 2572 bp, Glycine max
gcgcccacgcgtccgtacggctgcgagaagacgacagaaggggtgtgtgttaaggagagggtgagatgctttcgtctaagcttgctcaaactggcctcgtctatgctgtattgggcagttgtggaatacaaagatctttgaacatctcctttactacatttttgcaacacctacctctttctctctctctctcgtgggcggacgcgtgggcggacgcgtgggcggacgcgtgggcggacgcgtgggttccttctctcaattcccaacctcgcatctcccattattttattctcaaaccacgacaacaaaagcacaaacttggtttctcaatttcttcctctcgatcctacccgagttaaattaaaaacaagaggagagaaaacaaaacagaacaaaataaaggtttggtcttttgaagtgggagtgaggaatcagacatctgggttggttgcttgctaggttcggttaatgttagaatgtgggatctcaacgactcacccgatcagaggattaacaaggacgaggaatccgaagaagggtgttcttccctcaataaaacttccttcgatggagatgatgacaacaacaacaacaaaggcaaaaggctcgagtctgtttccaattcaagctcttcagcagtagtcatcggagacgggtcagaagaagagtacgaggaggaagaagaagatgaagaaggtgttggtgttggtggtggaagaagtatgaagaaacgtagcagcaagattttcgggttctctgtgacccaaaatgaagaagagtccatggacagtgaccatccacctgtgactagacaattttttccggtggaagatgctgacgtggcggttgcaaccggtggtggtggaaccggtgtaagctcaacgttccctcgtgctcactgggtaggtgtgaaattttgccaatcagaaacacttggcaccggaaaatcatcagtggaagtttctcagcctatgaagaagagtcgccgaggaccgaggtcaaggagctctcagtatagaggagtcaccttctacagaagaacgggtcgctgggagtctcatatatgggattgtggaaaacaagtgtatctaggtggatttgacacagcacatgcggctgctcgtgcatatgatagagcggctattaaattccgaggagtggaggcggacattaacttcaacattgaagattatgaagatgacttgaagcagatgagcaatcttaccaaggaagagttcgtgcacgtgcttcgccgacaaagcactggatttccgagagggagttccaagtatcgaggtgtcactttgcacaagtgtggaagatgggaggctcgaatgggccaatttttagggaaaaagtacgtttatttgggtctcttcgacactgagatcgaagctgcaagggcttatgacaaagctgccataaaatgcaacggcaaagaggcggtaacaaattttgatcccagcatctatgacaatgagctcaattccgaatccacaggtaacgctccagatcacaatctggatttaagtttgggcaattcaacttcaaaccctggcaacgatcaagcgttggggaatcaagccccaaatgctgtaacccatgatcagcacatgccatctgagtctaattggcgtaatgggggaatcaagcctaagctggtgaatatactcccaaaaccatgttacagaagcaacaacaaggacacacatggaagggatgtgcacggggagagtgaaacactgaggatgctaagtcaaacccaccttcattctccagccttcaatgaaatgcaacaaagatatggtccctacaggtctccgggaggagagtctcaaatgcttcaaaattttgcgcacattcacccaccaaattttcattttcccagaagcagcattggaggccgaattgggagtgatctttcattatcagtggctgatcaacaacagtggcaaaccgggccttcacgttatttagcaactgctgcagcatcatcaagtttccaacaagagataagaccctcttctcaaggttggctgcagaaaaatgggctccacagtctcatgagaccctcatgatccctattataaatagagaattttctgcctcgccaagtactagttacattcaaataatcgtaatctgctccctaagtaatattattattgttacccttccagggtttcacccccaaaaaattattattttcttttcttagcatgtaaaataggatgcagtgttagattgtgtccatgtccaacccagacccctcgtcacacaaggccacaactttactattgaggtgaaaaagaaaaggataaaagaaaagaaaaaaaaaaagaagagaaaatccaaattgggaacttactactggtctggggtcagtcaaactaacaaacggacgaaatctttaactagatattctgggctctgactaaaattttaggatcttatataactctgattttattgcttttctgcggttgtggtatatttatgacagcacctattcgtttcttgatttgggatgtattgctatcacatataaaaaaaaaaaaaaaaaagtgttcat

SEQ ID NO: 203 - DNA, 2516 bp, Glycine max
ttcttacagagaacatctgctgtttgtgacagggcactcaactccccccttcaaacaacagtgattcatcagatgatggtgttccagtttcaccaccaagagtcagactcagagatgggaggtacttggcttatagagaaaagggtgtccccaaggaccaagcaaaacacagcatcatcattgtacatggctttggacccactaaggtaacattgacattgattctacaggaactaatagatgaattgggtatatatattctgcaatatgatcgagctgggtatggagagagtgatccaaaccccaaacgctcactgaaaagtgaagcacttgacattgaagagcttgctgatctgttacagatagggtcaaattttatttgatcggtgtctcaatgggatcatatgctacctggagttgtttcaactacacacccaacaggcaaattacaagcctcaaaatatacatttctaaacatatgtttggtttcagaaaatgtcaattttcattttttattttcacaaataattatgaaaacgatattacatttctaaacaatgtttggtttcagaaagaaagtaaaaataaaaagcacaaagtcattttctgtaactatttgtgaaaataacatattctcaagccaaactggtcaaaattctccctttttatgttgttttgtaattatttggtgtagggattgcgggaaacaagtctatttgggtggatttgacacggctcatgctgctgccagagcctatgatcgagccgctattaagttcaggggagttgatgctgatatcaatttcaatctgagtgattatgaggatgaccttaaacagatgcagaatttgtccaaggaggaattcgtacatatactgcgtcgccaaagtactggtttctcaagaggaagctctaaataccgaggagtaacactccacaagtgtggccggtgggaagctcgaatgggacaatttcttggcaaaaagtgaggacatatttttatatatcaacttacgtagtgatctactgtggttatgaaatattatgaatttaagcacctattgggctgcaaagtgaaattggtttcagcttaattctcaatgcatctttatgcttttttccatgtttggagaaacatgtctaagatagtaatatagagatgcgttttggttatagagattgcaatgctttcatgcaggtatatatatcttggactattcgacagcgaagtagaagctgcaaggtcctagtgatacatgaattacattctacccgcactgaatttatttacatgaattatcaaagctcattaggctccatccaacacgtatctcccttttgattttctggaaatcagggcttatgacaaggcagctatcaaatgcaacggaagggaagcagtgaccaactttgagccaagtacttatgaaggagagctgaaatctgcagccattaatgaaggaggcagtcagaatcttgatctcaatttgggcatagcaaccccaggacctcccaaagaaaattgggggcaacttcagttcccctccttcccttacaatacacatggtggaagaagttcaatggtataattgaaactcatcttcatttattttaagtttcttgtaaattaagctgaatgaggtggatagcactttttatgctctcatgttagggtgcgcttgattgatcgttaatcgttcagttctatttaacagcaatgaccatagagatatggattgacgttagaagtgcattagaaagtgggagacgaataaaacaatgacacttaatttataacataactcttcatatcatgataactgttgagaatgcttgtctggctgtaacatttttgtagctttcgtgggttttccttgtagctaattacaacctgtattcctttgatttccttgattttttgtggaacttttggtttttggtattgttttatcaactctagatgtcatatattaacatggttctctttatctgcagatggaaaccaatgttagttctggaattggtaatccatctttgaaaaggatggttgcaactgaagatcgtccttcattatggaatggcatgtctcctaatttctttcccaatggggaaagagcagagagaatcggcgttgatccttcaaacggactccccaactgggcgtggcaaacacatggccaggtcaatgctaccccagtaccaacgttctctgctgcagcatcatcaggattctcaatttcagctacctttccatcggctgccatctttccaacaagttctatgaactcaattccccagagtctctgttttacttcatccagcatgcctacccgcaatgcatctgaatattattactaggttaagcccccacaggcaccaccatagctgattttgcagtacagattaaagacaaactaaaacaaaagtgttttcggtccaaattctttttataattcagccactgattggtgtatactgagattcgacaccttattgctgtctcttgcttaaactat

SEQ ID NO: 204 - DNA, 919 bp, Glycine max
gaggaagttctaaataccgaggagtaacactccacaagtgtggccggtgggaagctcgaatgggacaattccttggcaaaaaggcttatgacaaggcacggacgcgtgggcggacgcgtggggcagtgaccaactttgagccaagtacttatgaaggagaaatgaaatctgcagccattaatgaaggtggcggtcagaatcttgatctcaatttgggcatagcaaccccaggacctggtcccaaggaaaattgggggcaacttcacttcccctccatcccttacaacacacatggtggaagaagttcaaagatggaaaccaatgttaattctggaattggtaatccatctttgaaaaggatggttgtaactgaagatcgtccttcattatggaatggcatgtctcctaatttctttcccaatggggaaagagcagagagaatcggcattgatccttcaaaaggactccccaattgggcgtggcaaacacatggccaggtcaatgctaccccagtaccatcgttctctgctgcagcatcatcaggattctcaatttcagctacctttccatcgactgccatctttccaacaagttctatgaactcaattccccagagtctctgttttacttcatccagctcgcctacccgcaatgtatctgaatattattaccaggttaagcccccgcaggcaccaccatagctgatctagtagtacagattaaaggcaaacaaaaaaaagtgtctatggtcgaaattctgtgtaattcagtgactgattggtgtatactgagatttgacaccttcttgttacctcttttgcttaaactctaagatctttgaagcaaatgctatttttagtgcactggcacaacgatgtttctgtttcccacaaaaaaaaaaaaaatcaagattcatggt

SEQ ID NO: 205 - DNA, 1942 bp, Glycine max
agttaacacttcacaatatctttgcttttgaggccaatcacatctctgtgtcagtctcaaccatgctcttgtttgtgccttattccctctgattctggaagaagctcctgttctttcttatctttctccactgttttctccctgatcttcctctaccttaatttcagtctatttgttcttctgacagatactcttttaccctcaccaactcattcttctatcttcctctgctatgctcaacctttaaaagtcctttttccctctctctctctcctagtttgagtttcattgtactttgacttcactgcagaaggaagtacatgatactcttccaaaagggtaagctgattaaattagaagagagctttcccaagacatggctatgtttgatctcaatgtggacatcaaccatggtgatgctgatgctgattcaagctgtgatcaaaagggattgcagctgcaaagtttcccacctgaaatctcagcttcaagaaccgccaactcctctgtgtggaatcctgcagaggatgattcctcaaacaattcctctcccttgatttttgacatactgaagaaagagagggataagtcagagtttgatgctgccactgaaagggtcaataaggaggcagagatagtgacaaggacccttttccctgtgactgctgctgctgctgctgataatggagctagagtgcctgatttcaaattggggctgtgggggaagactcaatgcttgaacttgtgcttaccagagcctgatggacaaaatggactcagaaccttacagcagaagctacctcatgtgaggaaaaataggagaggaccaaggtctcgcagctcgcagtaccggggtgtcaccttctaccgcaggactggtagatgggagtctcatatttgggattgtgggaagcaggtctatttgggtggatttgacactgctcaagctgctgcaagagcatatgatagggctgcaataaagtttcgtggagtagaggctgatataaactttagtttaagtgattatgaggaggatttgaagcagatgagaggtttgagtaaggaagagtttgtgctcttacttcgtcgacaaatcaatggaagctcgagaagttcaacatacaaaggtgcattagcccttcgcaaagatgctcaaggagaaccacgaagggcaccatttattggcaagacattttatcccaactcatccatcaagtgtgatgatggaaaagtggacgcaagttttaagccctgttcctataagggagaaataattgcgaattcgagcatggcaggcactagccataatcttgatttgagcctaggaatttctccatcttctaaaagattgaagaatgactatagtggagggtattcctttggatgtatggcttcattggcttgtaagatacccaaggaaagaggaacaatggccatggtggacagaataagaaatgttcctttgcaaaaaatttccaacttggcttggcaactttgcagcaatggtagtagcattgtcccaaggccattgcaaccaaatgcagcatcatcaggattcgtctcttcttctagctgtctcatcaccgacacttccaatcaacacaaatattaattatgccaacaatttggcattaattggctcaaccacagtactactcatcattaaacccctaaaaggttgtacggccagagtagttgaaagttgaaaccactagaaacaaagcatctttaattactctgctttttggattattggatgagcaacgtgcttcataaccacatatatctatactataatattctattgataccatcagaaaaaaaaaaaaaaaataatattgcctagcatttaatacaaaggaaatcggataacttctgtattcattattgtgatgtagaacccaatattaccgagacccattaaagagacccttgtttgtag

SEQ ID NO: 206 - DNA, 1728 bp, Glycine max
attcggctcgagattatttggtgtagggattgcgggaaacaagtctatttgggtatggatttttaatttatgaatttatgaatttcagtgtttattttagggtacatagtttttgtactatctgaaatcgtattctatggtttactattttaagcatcttttgacaaaattggtatttgagcttgtaggtggatttgacacggctcatgctgctgccagagcctatgatcgagccgctattaagttcaggggagttgatgctgatatcaatttcaatctgagtgattatgaggatgaccttaaacagatgcagaatttgtccaaggaggaattcgtacatatactgcgtcgccaaagtactggtttctcaagaggaagctctaaataccgaggagtaacactccacaagtgtggccggtgggaagctcgaatgggacaatttcttggcaaaaagtgaggacatatttttatatatcaacttacgtagtgatctactgtggttatgaaatattatgaatttaagcacctatggggctgcaaagtgaaattggtttcagcttaattctcaatgcatctttatgcttttttccatgtttggagaaacatgtctaagatagtaatatagagatgcgttttggttatagagattgcaatgctttcatgcaggtatatatatcttggactattcgacagcgaagtagaagctgcaaggtcctagtgatacatgaattacattctacccgcactgaatttatttacatgaattatcaaagctcattaggctccatccaacacgtatctcccttttgattttctggaaatcagggcttatgacaaggcagctatcaaatgcaacggaagggaagcagtgaccaactttgagccaagtacttatgaaggagagctgaaatctgcagccattaatgaaggaggcagtcagaatcttgatctcaatttgggcatagcaaccccaggacctcccaaagaaaattgggggcaacttcagttcccctccttcccttacaatacacatggtggaagaagttcaatgatggaaaccaatgttagttctggaattggtaatccatctttgaaaaggatggttgcaactgaagatcgtccttcattatggaatggcatgtctcctaatttctttcccaatggggaaagagcagagagaatcggcgttgatccttcaaacggactccccaactgggcgtggcaaacacatggccaggtcaatgctaccccagtaccaacgttttttgctgcagcatcatcaggattttcaatttcagctacctttccatggggtgccatctttccaacaagttctatgaactcaattccccagagtctctgttttacttcatccagcatgcctacccgcaatgcatctgaatattattactaggttaagcccccacaggcaccaccatagctgattttgcagtacagattaaagacaaactaaaacaaaagtgttttcggtccaaattctttttataattcagccactgattggtgtatactgagattcgacaccttattgctgtctcttgcttaaactataatgccccatgtttggatacatcatctttgaagcaaatgctatttttagtgcactagcacagcgatgtttctgttttcctcaaatttgttggcagtcaagattcatggtttgcatgccaaaaaaaaaaaaaaaaaaaaagaaaaaaaaaaaaaaaa

SEQ ID NO: 207 - DNA, 1160 bp, Glycine max
gcagaaggacgggaagatgggaatcgcatatctgggtattgcggagaaacaagtctatttgggtgagatttgacacggctcatgctgctgccagagcctatgatcgagccgctattaagttcaggggagttgatgctgatatcaatctcaatctgagtgattatgaggatgaccttaaacagaggcagaatttgtccaaggaggaattcgtacatatactgcgtcgccaaagtactggtttctcaagaggaagctctaaataccgaggagtaacactccacaagtgtggccggtgggaagctcgaatgggacaatttcttggcaaaaaggcttatgacaaggcagctatcaaatgcaacggaagggaagcagtgaccaactttgagccaagtacttatgaaggagagctgaaatctgcagccattaatgaaggaggcagtcagaatcttgatctcaatttgggcatagcaaccccaggacctcccaaagaaaattgggggcaacttcagttcccctccttcccttacaatacacatggtggaagaagttcaatgatggaaaccaatgttagttctggaattggtaatccatctttgaaaaggatggttgcaactgaagatcgtccttcattatggaatggcatgtctcctaatttctttcccaatgggcaggaaagagcagagagaatcggcgttgatccttcaaacggactccccaactgggcgtggcaaacacatggccaggtcaatgctaccccagtaccaacgttctctgctgcagcatcatcaggattctcaatttcagctacctttccatcggctgccatctttccaacaagttctatgaactcaattccccagagtctctgttttacttcatccagcatgcctacccgcaatgcatctgaatattattactaggttaagcccccacaggcaccaccatagctgattttgcagtacagattaaagacaaactaaaacaaaagtgttttcggtccaaattctttttataattcagccactgattggtgtatactgagattcgacaccttattgctgtctcttgcttaaactataatgccccatgtttggatacatcatctttgaagcaaatgctatttttagtgcactagcacagacgatgtttctgttttcctc

SEQ ID NO: 208 - DNA, 1703 bp, Glycine max
  misc_feature (1363)..(1363): n is a, c, g, or t
  misc_feature (1392)..(1392): n is a, c, g, or t
gtaggagaggtccaaggtctcggagctctcagtacagaggagtcactttctacagaaggaccggaagatgggaatcgcatatctgggattgcgggaagcaagtctatttgggtggatttgacaccgctcatattgctgctagggcctatgatcgagctgctattaagttcaggggacttgatgctgatatcaattttgatctcgttgattatgaggaggatctaaaacagatgaagaatctttcaaagcaggagttcgtgcacatacttcgccgccacagtaccggtttctcaaggggcagttcgaaataccggggagtgacacttcacaaatgtggccgttgggaagctcgaatgggacaattccttggcaagaaggcttatgacaaggcagctatcaagtgcaatagaagagaggctgtcactaactttgagccaagtatatatgagagcgagatgaaacctgaagctattaatgaaggtggcagtcacgaccttgacctcaatctgggcatagcaaccccaggacatggtcccaaagaaaataggggccatcttcagttccagtccatcccttacaacatgcatcccggaagaagttcaaggatggagactaatgttaattcggttattggtgatccttctttgaaaaggctggttgtaactgaagagcgtccttctgtatattccactttctttcccaatctggaaagagcagagagaatgggcatagatccttcaaaaggagttccaaactgggcgtggcagacaaatggccaggttaatgccaccccagtaccaccgttctctactgcagcatcatcaggattctcaatttcagctacttttccatcaactgccatctttccaacaaaatccatgaacccaattccccagagcttctgtttcacttcacacagcacaccaggtagcaatgcacctcaattctattacgaggtcaagtcctcgcaggcaccatcccagcctctatcttgtaatacaagtataaatggtagcccaccacacaagttctgaagttcaattctcaaaacgacagttaaaactttttttttttttttcctgtttgcatgatttagggatcggtacaatgttgttgctcatggtatgtttgtatgtgatgaaaagatttttttcttcagagagaaagtgaaaagaaaaaatgcatgatgtgttttaaaaaaaaaaaaaaaaaaaaagggctccccgcggttagaggtttttcaaggcttagcgtacgcgttttttgcgacgtcgggaccttttccttgggggccatctttccaaacaagttttaggacttcaatcccccgagttttcggtttatttatcagcaaggcctaccngcaatgcattggattatattactagggtnaagcccccacaggcaacccattagctgattttgcagtacagattaaagacaaactaaaacaaaagtgttttcggtccaaattctttttataattcagccactgattggtgtatactgagattcgacaccttattgctgtctcttgcttaaactataatgccccatgtttggatacatcatctttgaagcaaatgctatttttagtgcactagcacagcgatgtttctgttttcctcaaatttgttggcagtcaagattcatggtttgcatgccaaaaaaaaaaaaaaaaaaaaagaaaaaaaaaaaaaaaa

SEQ ID NO: 209 - DNA, 2256 bp, Glycine max
gcccagcattgtttcatacaagaacaaaacccacgcactctcttcttcttttttaatctccctcttcactgctctcgcgcgatgaaattccgtcctatattgttacacattcaacaaatgatgtgaatcccttcttgttgccgtagcctcacacactcacttcttccgttgtaactaactttacttttccttccaaacggcttctaacaaactctcgccgcgatgttggatctcaacctcaacgccgattctgcctccgacgcgcaaatggagagctccggcagcttcaattcctccgtcgtcaatgccgccgacaccgacgactcctgctcctacggcgacgccgtcgcctacaacttcgccatcctcaacaccaccaccaccgccacctccgacggacctcccctggccgccgccggagaatcctccgttcgcaccatccagctctttccggcggtcgaatcgggagcctcgccggcgtggctggatttttcgtcgaaggtggatcagaacggtgctccgcaggagcagaggatccctccccggcaaccgccggtgaagaagagccggagaggaccgcggtcgcgaagctcgcaatatcgcggcgttacattctatcgcagaaccggaagatgggaatcgcacatttgggactgtgggaaacaagtgtacttgggtgaggacgcaacgcaagtagaagattcgttttatgctaactgcttcagttttctttaatatcgctttctttttctttattttcttttaggtggatttgacacagcgcatgctgcggcaagggcttatgatcgagctgcgatcaagttccgtggcgttgatgcggatatcaatttcaacgttagcgattacgatgaagatataaagcagatgagtaacttcacgaaggaggagtttgtgcatattttgcggcgacagagcactggtttttcaaggggaagctccaaatacaggggagttactctgcacaagtgcgggcgatgggaggctcgtatggggcagtttcttggtaaaaagtatatatatcttgggctattcgacagtgaattagaggctgcaagagcgtatgataaggctgctataaaatgcaatggaagggaagcagttacaaacttcgagcccagcttctatgaaggggaggtaatttcccagtctgataatgaagataacaagcaaagtcttgatctgaacttgggattagctcccccttcttactctgatggtcaaatcaagaacacacccagcaatgggagtggtatgataactccgcacagctgggataatatccctctcgacaagagagtaatgtttgagcactctgcatcaagatcactgaccgttcagccatctcatcatggcttctccgtagcatctgggcaacatccttccgtctggaatggtagcaatttctttcctatctacgaggaaacagcaatagagaagaggatggaagctgctccagtgccaaattgggcatggcaagtccaaggtccttatggcagggcaactcttgctccacccttctctactgcagcatcatcaggattcccttcaacaataataccatcagctgcggatactcaaattcgttttccaaacatgacattcctccactcgcattttccatcatcaatcactaactccggcaccatatcccctttcttcttcggtagctgaatgcattgctaggtagaccaaagcaattgcaaatcttcttgatttcaccatatggttgacaaactagtaggactagttacaagtagcaattgaatttgcttggttctacagcttttactatttgccattctactagttttcttcaatatatgtaaagaaatgccatgccccgatggcttcttgaactctgcttttactgatttttgagactaagcgtttactttggtatctccaacattcaatctcggtgcttttctatctagaaaatacttgaaaagatgagtttgatctttttgaagagacggaatttgtagatttgaaagcatgctaagttcaatccggctttgtgggtcatagttgtgatttttctttgcttccgttagttagtccttagtcgccagtagccaatgtttattattgccgacataacactattcacaaattttggcttgaatcgcttcacatggttattcttatatttaaggaacagcaaagctgtcttatggtctttgttatgattcctcccctatcctaggtcgaagtttatatattgattttctgcgc

SEQ ID NO: 210 - DNA, 1406 bp, Glycine max
attcggctcgaggtctaggtggatttgacacagcacatgcggctgctcgtgcttatgatagagcggctattaaattccgaggagtggaggctgacattaacttcaatattgaagactatgaagatgacttgaagcagatgagcaatcttaccaaggaagagttcgtccacgtgcttcgccgacaaagcactggatttccgagaggaagctccaaatatagaggtgtcactttgcacaagtgtggaagatgggaggctcgaatgggccaatttttagggaaaaagtacgtttatttgggtctctttgacactgagatagaagctgcaagggcttatgacaaagccgccataaaatgcaatggcaaagaggctgtaacgaattttgatcccagcatctacaacaatgagctcaataccgaatccacaggtaacgctccagatcacaatctggatttaagtttgggcaatgcaacttcaaagcctggcaataatcaagcgttggggaatcacgccacaaatgctgtaacccatgatcagcacctgccatctgagtctaattggcgtaatgggggaaacaagcctaagctggtgaatatactccccaaaccatgtaatagaagcaacaacaaggactcacatggaagggatgtgcacggggagagtgaaacactgaggatgctaagtcaaacccaccttcattctccagcctccaatgaaatgcaactaagatatggtccctacaagtctcacggtggagagtcccaaatgcttcaaaattttgcacacattcacccaccaaattttcattttcccagcagcagcattggaggccgaattgggagtgatctttcattatcaatgactgatcaacaacagtggcaaaccgggccttcacattatttagcaactgctgcagcatcatcaagtttccaacaacagataagaccctcttctcaaggttggctgcagaaaaatgggttccacattctcatgagaccctcatgatccctattatatatagagaattttctgcctcgccaagtactagttacattcaaataatcattaatctgctcctcaagtaatattattattattacccttcaacggttccaccccaaaaaaaattattattttcttttcttagcatgtaaaaaggatgcagtgttagattgtgcccatgtccaacccagacccctgctcacacaagaccacaactttactattgaggtgaaaaagaaaggataaaagaaaaaggaaaaaaaagaagagaaaatccaaatggggaacttattactagtcttggtctaggtcagtcaaactaacaaacggacgaaatctttaactagatattctgggctctgactaaaattttatgatcttatataactctgattttattgctaa

SEQ ID NO: 211 - DNA, 2796 bp, Glycine max
ccctcgcttccggctaaccaaagaggcaaaggtggccctcttcccgtactcttggattggacttttctggaaagagtttccttttacttgtattattctcatttcccttttctgatgccaaactctctctctgccgtggtctcgactcacaataattaatattccaccttcttccccaaatcgccctccctcatcacccctatttactttctttcccacttagtcatggacttggatgcactcctaatactcatctttaaccatcactctacaacgctaacaaaaggttgttctgagtaattatctttcttttggactcctcgcgctgtctatttccttttcgacccagagagagacagatagacaggagatgctttttcgatttcgttaacgtgagaaagttttttaagaaagagatgcttgatgcttattggttttggtctttcctttccttttccccccatttttacccccttgcatttttatttattaattaatcacataaaaacggaaacaataaataacagtacggtgattattttaaacaatatatatataaggagtttcctcctggagaagcaaaacaaaaatagattgtaggcatttatttgagtaatataaaaagaaagagagaagagattgttgaagttggggatgctttcggctaagcttgctgaaactggcctcgtctatgctgtattgggcagttaggcgaattcaaagatctttgaacacctccttctttattacctttttccaacacctacctcttctttctctttctccctctcacacactcgtcctaggtttgattttcccttccttctcccaatactcctccattattttataacactctagcttcgttacttgcccttttctctgcccagctacatgcttgtgtaagaactaataagccagctgaagaatgtgggatctgaatgactcccccgatcagagaaaggactacgagtctgaaggctgttcttcttctctgtatgatgataaaggcaagagggtggcatctgtttccaattcaagctcctctgcggtggtcgttgaagatggatcggaagaagaagacagtgaaagaggtggaagcagaacattggataacaagaaaaccaacaaaatattcggcttctctgtagctcatgatgacagtgaccacccacccgtcactcatcagttttttccggttgaggactccgaactgcctgtctccgccgccgccgcaggcagtggaggcggtggcggcggaagctccttcccacgtgctcactgggtaggtgtcaaattttgtcaatcggaaacacccggcgccggaaaagcagtgaaagtgtcggagccgatgaagaaaagtcgccgaggaccacgctcgcgtagctcacagtatcgaggagttactttctacagaagaactggtagatgggaatctcatatatgggattgtggaaagcaagtgtatttgggtggatttgacacagcacatgcagctgctcgtgcgtatgatagagcagctattaaattccggggagtggaggcagacatcaacttcaacatcgaagactatgaggaagacttgaagcagatgaccaatttaaccaaggaagagtttgtccacgtacttcgccgacaaagcactggatttcccagaggaagctccaaatatagaggtgtaactttgcacaagtgtggaagatgggaggctcgaatgggccaatttttgggcaaaaagtatgtttatctgggtctgtttgacaccgaaattgaagctgcaagggcatatgataaagcagcaataaaatgtaatggcaaagaggcttgtcaccaatttttgatcccagcatctatgatagtgagcttaattctgaatcctcaggaggtggtagctgcagatcaccaatttgggatttgagttttggggtaatttgatctctaaacataacaatagtcaaacatcggggaatcacttcgcaaattctgcaaccgatcagcatatgccacctgaatctaattggcggaatgggggaagcaagcctaaggttcatctggtaaatatacttccaaaaccatgtggtagaagcaacatagaagcctatgggcacggtgagagtgaaaccttgaggttgctaagccaaactcaccttcaatcccctaccaataaagaaatgcacagatatggtccgtataggtcgccagcagagcccacaaaagcctcacaattttgcacatcatcttcaccaaccaagttttcatgttcctagcagcagcagcaatggaggccgtattggaagcgatctttcgttatcaatgtccgatcaacaacaatggcaacaagccgggcctccacatttgttagcaactgctgcagcatcatcaggattcccacagcaaattagaccctcccaaggttggctgcagaaaaatgggttccactctctcatgagaccctcatgaccatcctcaagattttttctaccatgccattttgcattttgaaaaataatctccccctactatttgttttgtgaacatgtacaagtgaaagtgaatgcagtttagattattgtttatgttatgtccaacctcccccttctttaggaaaagcccatacataactgtaactttactattggggtgaaagacaagaagggatgaaaaaaaaatagggaaagccaatttgggaactcgctctggatttgttataggccagtcaaactaaccaacggacaaaatctttaactagatactaagatattctgggcgctgactaaagtttctgatctgatcttt

SEQ ID NO: 212 - DNA, 1198 bp, Glycine max
  misc_feature (176)..(176): n is a, c, g, or t
  misc_feature (385)..(385): n is a, c, g, or t
  misc_feature (1072)..(1072): n is a, c, g, or t
  misc_feature (1108)..(1108): n is a, c, g, or t
  misc_feature (1123)..(1123): n is a, c, g, or t
  misc_feature (1193)..(1193): n is a, c, g, or t
ctattggtggtttgaattgggagtatggttaagcattccggtttgacctaatccaagaacttcattagagtggagagaatcttgttgttgttggttcatcctgagccgcatatcttgacttttatgcttcgaattagccgaatttcccaagctcaaatcgaggttgtgatcttgangagtagtaggattccctgatgactcggcagctcctgcaggcggccgcgtggatgaggagttaatcggtcgtgtgagagtagtgatcgagtggatgtcgtcgagagtgatgagtgttgatgttgttagtgatatgtggtagaaggtatcgtgataaagcgttaacgcgatcgcagtactttgccgagtcatcagggaatcctactactcntcaagatcacaacctcgatttgagcttgggaaattcggctaattcgaagcataaaagtcaagatatgcggctcaggatgaaccaacaacaacaagattctctccactctaatgaagttcttggattaggtcaaaccggaatgcttaaccatactcccaattcaaaccaccaatttccgggcagcagcaacattggtagcggaggcggattctcactgtttccggcggctgagaaccaccggtttgatggtcgggcctcgacgaaccaagtgttgacaaatgctgcagcatcatcaggattccctcctcatcatcacaatcagatttttaattctacttctactcctcatcaaaattggctgcagacaaatggcttccaacctcctctcatgagaccttcttgagcggccgccaccgcggtggagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaaattttaaagtgactcttaggtttttaaaacgaaaattcttattcttgagtaactctttcctgnaaggtcaaggttggttttctcaggtataggcatgangtcgctcttaatggnccacaccttttacccgggcatgcccgaggcaaatgccctggcaaaatcggttccccaattttaaccccanttgga

SEQ ID NO: 213 - DNA, 2261 bp, Glycine max
aagagacagaaggggaaacgattctccgtttattcaaaaacgaaaaacacatctctctgattaatacgcactctcgctgtgagtttgaatttagttgggagactcgaaataatgtcgtcgacgacgcagaatcgtcgttcgtcgtttactccctcgacggcgtcgtctttggcgaaagcgaaacgacatccatcgtcggtgtcgtcgtcgtcgtcggggaaggcgaaggtggtttctactcagaacttggctgtgaagagagcgcctctcgccaacctcactaatcaaaggaacgcgccttattcttcttcttcttcttctttggtgcaaggttcaaataaagttgccaagaccaagaaagaggctcctgcaagaaccagcgtctcaaaatcaacaatttctgggaacaaatcttcccagttaaaatctgttaactcaagctccgttgttattccaaaggctaattctttatcacaaaagaaggatgctgctcccacagttgccacatttgccgtgcctgttcgtagcggcattgatgtttctcctagtaaatcagatggaaggttcgtttctatggatgagacaacatcttcatgtgattctatcaagagtccggatgaagttgaatatctggataacagggatgtttcagatgttgattcaattcagaaaaagataataagcaatttgaacatttctgataccacagagcccgaaggaaacgtatgtagtagggaaataattgttgagttggaagaaagagtggacaagattgtcaatatcgataacatttactctgatacgcagctttgtgcaacctatgtttgtgacatctacaaacacctacgtgaatccgaggaaaagaaaaggccttccactgacttcatggacacaattcagaaggacataaatgttagcatgcgcgctatattggttgactggcttgttgaggtggctgaggagtatcgtcttgtacctgaaacattgtatttgacagtgaactacttagatcggtatctttcagggaatgctatgaataggcaaaggttacaacttcttggtgtttcatgcatgatgattgcatctaaatatgaggagatttgtgctcctcaggtggaagaattttgttatataaccgacaatacttacttaaaagaagaggttttgcaaatggaatctgctgtcttgaattatcttaagttcgaaatgacagctccaacagttaaatgtttcttaagacgatttgttcgtgcagctgctcatgatgtccaggagatcccttcacttcaactggagtacctaaccaactttattgccgaattatctctcttggagtacagtatgttgagttatcctccatcactgatagctgcttctgtaattttccttgccagatttatacttttcccttcaaagaaaccatggaattctacattgcagcattacacgctctaccggccttctgacttgtgtgcatgtgtaaaagatctccatcgtctttgttgcagcagccatgattctaatttacctgcaatcagagataaatacagtcagcataagtacaaatgtgtagccaagaagcacatccctccttcaatacctcgagaagttttccagatcaactgaacaaaggaattcaacgacaatccaataattgggatgcacatgctaagttttgacaaagcttcagtctctcaatgatgcaaggaccatttcctgttagaagcatagttggaaccaggaagaggagaggacacatgtgctggtggagctagtgtgctcttctatggttcaatgtctatgctcagttgcacaccatgaagagcttgaaagaaatgacatgatttccactcggttccttcttattattaaaatgaataaaaaacaaactaagcatgtgttagtataatttagtaaaaagccagaggattgaagttgaatttttctttcttttttattctaaaaaattgaacttaggtatcaatgggtttacaactagggacttaaatgagttaagttattagtaaactattgagttcgacttgttaaataaattaaataaacaaactaaagctttggatttgactcaattatttaaataagtcaaacttaagttttacaaactgaacattaatggttcgtaaattccatgcacatatatcatagaaaactgaaattacataaattccataatatcattctacatatttctatttgtaaattattatttaatattcaggtctgaagttgttttgcaaaaa

SEQ ID NO: 214 - DNA, 480 bp, Glycine max
ccaaagaggcaaagaagtaacggccccagcggtccagcaccctgtgctcccctttcccaccaccaccaccaccatgcctctgtcgccttcgacaggagcacacttcagtccaacaccgtctcgacgccacagtggccgccgtcccagcacccgtttctgatgcagaggttctctgctgctccagccgagccttcgcctatgtttcccttctttcttggaggcaacagcgcttctgctgctgctcctgccgcggccaatgcgccggagcggaggctgcagctctgggacttcaaggaggaaaggaagacataatttcttcttgtagagattcggcggtgtatcaacctaccaagtcatgatccattcagcacagaagaacccagaacgagagaagatgcaaggcaacgaaggcgtcggcgccatggaggcgcgtggaacacaaatgcttattagctggatctccaagtcttctccgcgcgg

SEQ ID NO: 215 - DNA, 252 bp, Glycine max
tcgcacgcgtacgtaagctcggaatgcggctcgaggacggcgaacttttttagacagagcacctgcaccagcaccagcagcagaaccaccactcggaggaacagcgaatgctttatgctggtggtaacagtggccacggcggtggcttttgggacaacacgccggcgccagtgcaagtgcctgcgttttgccagtattctgctcacaggggaccccttcagttcagtaacaccccttcgattcgtgcttgga

SEQ ID NO: 216 - DNA, 773 bp, Glycine max
  misc_feature (684)..(684): n is a, c, g, or t
  misc_feature (696)..(696): n is a, c, g, or t
ttctgggtttctgcccgcgtctttggacactgacaacattgcggagacattcaagactttctttcctgtggaagcgacctcgacgtcgtttcagagttacccgccggcgccaccggatttagggcaccaagatctgcggctctcgttgcagtcctttcaggaccctattatgcttcaccaccagcctcatagccaccaccaaccggttccggctggtcagagcacctgcaccagcaccagcaacagaaccaccactcggaggaacagcgattgctctatgctggtggtaacagtggccacggcggtgggtttgtgttcaacacgccggcgccggtgcaggtgccggcgtttggccagtttttttctcagaggggaccccttcagtccagtaacaccccttcgattcgtgcttggatagacccttcggtcgatcaccaccaccaccaccatcactacctatcacagttgatccaccaaggatccgtcgccggtggcggcggattctccggcttccgcattcctgcacgaattcagggtgaagaggaacacgacggcgtgtcccgacagccgtcctctgctttctctgattctcgccattgatttgaaaaacacacattcaaaacccccactttgttctcccctagggttttgtgggtttgattggagattggtcaattggtgganagaaacatattnttggagatcatgattgatggatttcaagcctacacggggaattgagaagatctgaaggggatattcagggttcccat

SEQ ID NO: 217 - DNA, 740 bp, Glycine max
acgagaccccatcaattttcaaaccaacaactcctcagaagatcttggcctatccctccattgcttccaagaccaccctggcctcattcattggcaatcacaacagacaggtgcacatcaaacacctccttcaaatgaacaccaaatccgaaccctttttgctggctcaaccccaggtggctttgagaaccattatcaaagaagtgtgacttggaacaatgaagcaactaccactgatcatgtgaacaggttggggttcatactcaactcacagccatttataggccaaggttctacttcagcttatgctcaaagtggggggacccttcagtccagtttttcatttccaatgacttctccctctgagcttcacaggccccagccagtgaaccaaccttccatctttgacagcaggtttgtgtctgatggattagctgatttctgcattccagatagaattcaaggtgtggaagagaaccatggagttgcttccaataggccatcttcttcccctagttctatccactgatcccaaactaagcaatgcttaagtcttcctatcaggagtgttctctatcagattggcaaccgagtgaagattcaataggcatattgttatgatctacaaagatttcctttcaatttggctttccttttttcggtttttaattttaaagtgagttgcccttgattcaacccttgaaatctatatgtataattttgaattgatgaaaattacc

SEQ ID NO: 218 - DNA, 751 bp, Glycine max
  misc_feature (601)..(601): n is a, c, g, or t
ttggtcaaggccagtattttactcagaggggaccccttcagtccagtaacagcccttccgttcgtgcgtggattgacgcgccgtcgttcgtcgctgccgccgccgatcatcggcatcatcatcatcactatctgtctcccgcggcggccgcggcggcgttggtgtatcagtctgctccttcaacggcggcatttgcagcggcgcccggtggcttctcgggattccgcgtgccggcacaaattcagggcgaggaggagcatgacggcggcgtgtccgataagccgtcctctgcttcctccgattctcaccgttgattctcgccgttgaaccgcccgccaacatcctcagccgatttcggtctccttggaatcaattgggtatgtgtgtgatctgttttttgcagggatgatgggggagatggagtttgacttggaatggtttggttcggttcagtggactattatgcttgtggaatgaagaaaatctggggttgaatttccaggttttgaattctccagtttgttatgttaatttattttatgttttccatgtttcattaaggtgactttcaagtttgagtacactgttgtgtgttggattntacttttgctgtttgttatcaattcgtagtattggatgatctatttgaacttgtttggtatctagtttttggtttgaaacatgcacgtagatactgctatatcacttattcactggctagtttgctcggattatctttggatttcccact

SEQ ID NO: 219 - DNA, 831 bp, Glycine max
accatcactcggaggaacagcgattgctctatgctggtggcaacagtggccatggcggtgggtttgtgttcaacacgccggcgccggtgccggcgtttggccagtttttttctcagaggggaccccttcagtccagtaacaccccttcgattcgtgcttggatagacccttcggtcgatcaccaccataatcgaaaacactacctctcgcagttgatccaccagggttccgtcgccggaggcagcggattctccagtggattctccggcttccgcattccagcacgaattcagggtgaagaggaacacgacggcgtatcggacaagccgtcctctgcttcctctgattctcgccattgatttgaaaaacacatcaaaaaccccaactttgttcttcctcagggtttgtgggttgcattgaagatgtttaaattgatggagagaacatgcatttggaagattaggatggatgaattttcaagctacaatgggaattcaagagagttgggtttggatttcagatgtgtttattttaatggcctatatatgccgtgggaatgaagaaaatctgaggtggatattcaggttttccaatccctcggtttgttatgctttttatgttttacttacgtttttctgtttaatttaaatagaactaggagtattgtgtttcttttgtttcatctgtattggattgctatgtttccatttgttaagtgattgtgtctactttgtacttcttcagtttcttgtttcttgtagtgatttgaaaaccatgcaaattaaataaaagagctagtttgctctagttattgtaaaaaaaaaaaaaaaa

SEQ ID NO: 220 - DNA, 1846 bp, Glycine max
tttcactcttttctctctctttacaagtgtaacataacaaacataaagagaaagacaaaagtgtgtgttttgtgcaaggcatgattgtggtatggaggaggaggatgagattcaagcacagaaggtgagaagaagaagaggcagtgatggagagagcacgaacaggttccacagcagctggcaccaccaccaccaccactcttcgaggatcataagggtgtctcgtgcatctggtggcaaagacaggcacagcaaagtgatgacttcaaaagggttgagagatagaagggttaggctttccgtgaccactgccattcagttctatgaccttcaagatcgcttgggttatgaccaacctagtaaagctgtggaatggcttatcaaatctgcttctgattccatttctgaacttccttctttgaacaatttccctgacacccccaaaagtgatgatcatgagaagagagcaaaacaactgatgttgctgctggggcagtagatggtgagaattatgaaaatgagaatggcaaataacaataaccagagtcaggaacatgtcttttgtctaaatctggttgtastagcacttctgagacaagcaaaggttctggcttgtccctctcaaggtctgatattcgtgtgaaggctagagagagggcaagggagagaacaacaaaggaaaaggagaaagagaaaaatgagtctcatcatcatcacagcaatgttgttgttcctcatcatcgtcatcatcatcatcataaccccgtttcacaaacagcttctttcactgagcttctcactggtgggattcccaaagggtgtgatgatgaggagcctaataacatgatgatgttcaacaaagaagctgcagcagcatcatctggtagacagcaatggtgttcatcatcatcagcagcagcagcagcacctatggactactttctggggccttcctcttctagaacaacaacaacaccaccacacaatcaccatcaccatcatcatcaatattcttcttctggtgggttctcattggcacaaatccaactaggacattctcttcctgaggcgaatgaatcacaatgtttcagcattcaacaataatgtgagtggtgagaaccaaaaccactcatcatcagatcctcatctgcaacagcagcaacacttctcattcataccggatcatcttatgtcagctgtggttacttcttcttctcatcatcaacctagcgggagcgactacaatctgaacttcaccatgtcttcgggcctcgctggttacaatagggggacccttcagtccaattctccgtctcttttgcctcacttgcagaggttttcgcctctagacggatccactgtacctttcttcattggagctgctccttctgctgcagttgctgctcctgccatggagaacaacaccaccaccaccaacaaccatcaccaccatcagttctcatctggtttcgatggcagccgcttgcaactctactatgggcattctgaccagaaggggaaagccaaaaactgatgtttggattgctacatttcctcctggacttgaaaattaaagtactagcagcaagttgtgtcctaaagcttgcttttgccaaaagggatgagccggcgttgtcaagtgttggtatttcttgttggatcatttgaagtcattcaattacatttagtatttggatatatatatatatattgatctatgcgtgtgaaatcattgtgtttttggataaatgtaaaagctacttgattcaagatattcttttactttctgcaattattttgatattgttgtctatactataaatggagaaaagagttgttcatcagc

SEQ ID NO: 221 - DNA, 2770 bp, Glycine max
ctcgagccgaatcggctcgaggtgttggttgtattgtgtataatgttgtgtgtagtgtagtgtagtgtggtagaagaacagcagcagaagaggggcagtgatgcactcacagatatttaacacctccattccgaccaaacactgtcaccctttaccactgccatcatcaagccctctcccatagggccagaatgaattcctcttccctataactgttatctagtgtctgcctattgtgttgctgagagatatgaaaaatttgttaatttttttgcaaaaagacacgagttggccaagaccaagagggtattaaccaacgcaaccgtattgtgtagtttcagtttggttagtacattacataagtgtataaagggagctcaattagcaaaaaggcaaaaaagtggtgtgtggagagagaaatagagagagaggggaaacagatgggttaggctgaaaagggagttggtataacattgttggtttggtttagtttagtttcctcggtagagagggctcttttttttattttggtggtgatggaagtgggaaaattgaatggcaggaactttttcaagaggctgaagcaagtttcagagtggtggcagttgcacaagcaacaagaagagaagaagagtggaaagaaacaaagctgggagtgcaaggaatcaacaacccattaggaataagtgcaaagcttcattaaaagctggaagaggaaaatcacaacaggggtctgactctggatcctcacaggaatcatcatcatcatcatcatcttctgcagcaacaacaacaaccacctcatcatcctcatcctcaaaatctgattctaaattcaataagacatgtaacagaccaagaaggagaaaaccaagaagaccaagaatctcattctcatcctcaccaattccatatccaattccaacctcttcatcatcaacaagaacaacaacaacaacaatcttacacaggtttagacacggagatcttaaacccactccaaccaccgaagaaacggtcttgcctaccgcctcttccgccgccaccaccgccgccttcgtcgcttgcttcatccgaacatgcaagaaaaatgggagagctacaacaccatcaacaacaggcagcagcagcagcagcaccgtcgagagcggcgatgagaggcgtcggcggcggcgagattgtggaggtgcaaggcggccacattgtccgctccaccggacggaaggaccgccacagcaaagtctgcaccgccaaaggccccagagaccgccgcgtgcggctggcggcgcacaccgccatccaattctacgacgtccaggaccgcctgggctacgaccgccccagcaaggcggtcgactggctcatcaagaaagccaaggcggccatcgaccagctcgcggagctcccgccatggaaccccactgccacctcaatgcaaccacgacagctgccacaagaaatcgtccactgcgagaacaaatctctcgcgatggacgattcaatgaccgctgccttcagtagccgcggcgaaagcaacgctttcgcctcccaccaacaagtggaggataatgaaaatgctaacaacattagcagcagcagcggcaacaaatacaataccggttctgggtttctgcccgcgtctttggacactgacaacattgcggagacaatcaagactttctttcctgtggaagcgacctcgacgtcgtttcagagttacccgccggcgccaccggatttagggcaccaagatctgcggctctcgttgcagtcctttcaggaccctattatgcttcaccaccagcctcatagccaccaccaaccggttctctttgccggaaccgccgccgcggcgctcgacttcgacggcggttccggctggtcagagcacctgcaccagcaccagcaacagaaccaccactcggaggaacagcgattgctctatgctggtggtaacagtggccacggcggtgggtttgtgttcaacacgccggcgccggtgcaggtgccggcgtttggccagtttttttctcagaggggaccccttcagtccagtaacaccccttcgattcgtgcttggatagacccttcggtcgatcaccaccaccaccaccatcactacctatcacagttgatccaccaaggatccgtcgccggtggcggcggattctccggcttccgcattcctgcacgaattcagggtgaagaggaacacgacggcgtgtccgacaagccgtcctctgcttcctctgattctcgccattgatttgaaaaacacacatcaaaaaccccaactttgttctccctcagggtttgtggggttgcattgaagatggttcaattgatggagagaacatgattttggaagatcatgatgaatggattttcaagctacaacgggaattcaagaaaatctgaggtggatattcaggttttccaatccctcggtttgttatgctttttatgttcaacttatgtttttcatgcttaatttaactaggactaggagtattgtgtttcttttgtttcttctgtattggagtgctatgtttcttttgtttcttctgtattggagtgctatgtttccctttgttaagtgattgtgtcttctttgtacttcttcagtttcgagtttcttgtagtgatctgaaaaacatgcaaattcaataaaagagctagtttgctctagttattgtataaaaaaaaaaaaaaaaaaaaaaaaaaaaaaaaaaaaaaaaaaaaaaaaaaaaaaaaaaaaaaaaaaaaaaaa

SEQ ID NO: 222 - DNA, 1638 bp, Glycine max
atttttatcaatgttagtcatttattattagtttttttttagtaacggaaatcaaactaagaccttttccttccaaccttctcctttttatcaccaaatcaacgttataactcagcatcaaccactaagccctatacaaagtgcgcatgactcacaacaacaaaacttgatcagcacacacaacacatctcattatcaagtatctcaaaaccaacatcaatattatgctgaaggcataacaagtagttcccacctactttgaaccaagccaaaaaccacacaaagcacaatagaggaggaacaacaatcacaaagggcatgaggaccaatgtaggagatattgttcaagtagaaggagggcacattgttaggtccacaggtagaaaagatcgccacagcaaggtgtacacatcgaaagggccacgcgatcgtcgcgttagactctcggcacacacagccattgagttctatgatgttcaagacaggcttggctatgacaggccaagcaaggctgtggactggctcatcaaaaaggcaaagacttccattgacaagcttgctgagcttcctccttggcatccacctactaatcatgaggaagaagagcagaatgatgctgcaggatcaagtggagtcatagccattgaacaacaacaacagcaacagcagcagcagcagcaacaacaacaacaacaacaacaacaacaacaacatcaacagcaacaatcagagtcttgtggttacaactttcagctccaaaggcaattgggagccttcatttcaacacatgttgacactgaccacatcaatttccaaaccaacaacaacaactcctcagaagatcttggcctatccctccattgcttccaagaccaccctggccttattcagtggcaatcacaacaagaaggtgcaaatcaaacacctccttcaaatgaacaccaaatccagcaaaccccttttgccggatcaaccccagttgggtttgagaaccattatcaaagaagtgtgacttggaacaatgaagcaacaaccacagatcatgtcaacaggttggggttcttattcaactcacagccttatgcttcagcttatgctcaaagtggggggacccttcagtccagtttttcatttccaatgacttcttcctctgagcttcacaggcctcagccagtgaaccaaccttcttcaatctttggcagcaggtttgtgtctgatggattagctggtttctgcattccagatagaattcaaggtgtggaagagaatcatggagttgcttccaataggccttcttcttctcctagttctatccactgaccccaaactaagcaatgctttagtcttcctttcaggagtgttctctaccagatttgaaaccgagtgaagattcaataggcacattgttatgatctacaaagatttcctttcaatttggctttcctttttttggcttttaaatttaaagttagttcccttgattcaacccttgctatctatatgtataattttatattgatgaaaatgaccttgtgctgaatttggttttgtagtcctctcactgtattgtgaatgttatttcagaataacatatttcatctgatatctacatgtccattcttggcaaagaatcacatc

SEQ ID NO: 223 - DNA, 1800 bp, Glycine max
  misc_feature (1771)..(1771): n is a, c, g, or t
  misc_feature (1774)..(1779): n is a, c, g, or t
  misc_feature (1781)..(1795): n is a, c, g, or t
cggtccggagttcccgggtcgacccacgcgtccgcaagcatcaagtctaataagcaagtcttgagagggagagacaacaacatcaagtgtctgagtctggatcctcaacggaaacgggcttttgcggctacggtggagcatgcaggaacgacgtcgtccagccaggggatggtgagaggaagcggaggggagatagttcaagttgaaggcggtcacattgtgcgctccacagggcggaaggaccgtcacagcaaagtgtgcaccgccaaaggccctcgtgaccgacgggtgaggttatcggcccacaccgccatccaattctacgacgtccaggaccgcttgggctacgaccgccccagcaaggccgtcgactggctcatcaacaaggccaagtcctccatcgaccaactcgcccacctccctccctggaaacccactctcccctcacccgcaccacctcatctaaacgacgaccattcagacaaacctaaccctaaccccaaccccaaccccaaccccaaccccaaccccaaccatagccctgatgcccaaattctcaaccagttcgaccacgacgatggagctggagctggttccagttatcttcctatggataacgacgcgataaggtcgttcttccccacgacgacttcctcgttggttcaattccagagctacccaccggatttgctctccagaaccagtagccaggacctgcgtctctcgcttcagtccttgcaagaccctattttacttcaccacaaccacaacaacaacgagcacgtgcttttcgctggaaccgcctttgataacatggtagcgtggaataataatagtaataataatcataataataataatcataataataataataataataataataatactgcttctaatgatacttgtggtggtggtggtggtggtggaggaggaggaggagggtttgtgtttaacgctccttcgactttgccggggccggcgacggtggcgtcgccgacggtggtgtttggtcatggttatggtcaaggccagtatttttctcagaggggaccccttcagtccagtaacagcccttccgttcgtgcgtggattgacgcgccatcgttcgtcgctgctgccgccgatcatcggcatcatcactatctgtctcccgcggcagcggcagcggcgttggtgtatcagtctgctccttccacggcggcatttacggcggcgcccggtggcttctcgggattccgcgtgccggcacgaattcagggtgaggaggagcacgacggcggcatgtccgataagccgtcctctgcttcctccgattctcgccgttgaaccgtcgagatcgtcagccgatttctgtctccttggaatcaattgggtatgtgtgtgatctgttttttgcagggatggaggagacgaagttggacttggaatggttcggttcggttcagtggactattatgcttgtggaatgaagaaaatctggggttgaatatccaggtttttgaattctccagtctgttatgttaatttattttatgtttttcatgtttcattagggagactttcaagtttgagtactgttgtgttggattgtctgtttgatgatgtttgttacaatttgtactagtggatgtatttgtacttgggtatctagtttcttagttttggtttgaagacatgcacgtagatactactatatcacttattattcacggcctagttggtcgatttatctttgtatttccaaaaaaaaaaaaaaaaagggggnccnnnnnnannnnnnnnnnnnnnnccggg

SEQ ID NO: 224 - DNA, 1945 bp, Glycine max
  misc_feature (436)..(444): n is a, c, g, or t
tagacaacccaaagaaaaaaaggaatctgaatctcaccctatagacacaagaatcaaaaaaggaagaacaatttatgagcatataaagtgggggggtgtcaattgtcatcactcatcaacaagttgtgcaaactgcaaaggggagcaaacttaaactatgcagaaagcacaatagaagaagctgaggaatgggcatgaagagcactggtttttttattgttcaagtccaaggagggcacattgttcggtccacaggtagaaaagataggcacagcaaggtttacactgcaaagggtcctcgtgatcgaagggttaggctctcagcacacactgctattgagttctatgatgttcaagatcgtttaggctatgacagaccaagcaaagccgtggactggctcatcaagaaggccaagaatgctattgataagcttgnnnnnnnnnggcaagaatgctattgacaagcttggtgagcttcctccatggcaccctactcctaacactgctgcagatgctgagaacaacaacaacaacaacaatgcagggtcaagtgacatggccattgcagcagaacaatctgagtcttctggttacaattttcagctgcaaaggcaattaggtgaggaccatgataaccaccattcggctttcattccctcacctattgacactgatgcaatagccttctttccaacaaccactgcaacctcctccatcaatttccaaacctaccctcctaatataatctcaagaaccaacaactccactgaggatcttggcctttcccttcactccttccaagaccctggtttgattcatggccagacccaagcaggtgcaaaccagacacaaacaccttccaatgaccaaagcctcttctctggctcaactcaagtggggtttgaggccaattaccccaggattgtcacttggaacagtgatgcaagcatagatatgaacagaaccgggttcatggtcaattcaccatcagcacttctaggccaaggtggttctgctgcgtattcccaaagggggacccttcagtccagtttctcaccatcacttcgtccttggagtgacattccaatggcttcatcagaacatcacaagtcacagccaattcaacaagcttcaatctttggcagcaggtttctgtctgatgcattgccggggttctgcattcctgctagaatccaaggagaggatgagggccatggagttggtaacgacaggccatcatctgcttctcctaattctcatcactgaccacaaacttgaactgcacaatactgcactgttccttatctatcaggacaggagcattgcctaccagactttaaaacgtgggaagattaagatggacacattttgatgatctacacaattttatctggttggattcagcttttatatggctttctttcccccctacttattgcagccatttacattggggctttatatattttttaaggaaaagagatatttatgtattatgcattatatttacctgatactttgctcattttatatatggctttaagctggattattccgtggttgtatcccgtatcgtttctttaatgtcgagaatagcatagttcatccaatatcaagtgaacagaagaggtttcatgtcaattcttggtgaaccccacttcaagaaaaaattgaatctagtatggttttgatttagttattctcccctgtagtagaaagacattttggttttgtatttctgcatctgcttcaatttcaagtaacaccatcaggaaggaactacagatggcttgtaatgtctcaaataataggcaaagttgtaaaatgtgatcgtggttgaggttttgcaatgtttgatatcttagaaaattgcagacaaataagactaatacattgtaaataagactataaattgtaaatgtagtcatgtagttgcaaaaagtcc

SEQ ID NO: 225 - DNA, 1167 bp, Glycine max
cattttgattcttctgcaggagatcatggacaaagaaaatacaaatgggcctttacattttgatctgaatactggtgcaaagattccatcggttggtcttggaacatggaaagctcctccaggtgttgtgggtgatgctgttattgctgcagtcaaggctggttacaggcatatagattgtgctaggatatatgataatgaaaaagaggtaggggaggctctgaaaacactattttctactggggtagtacagcgtagtgagatgttcatcacatcaaagctatggatcagtgactgtgcacctgaagatgtctcaaaggcactgactaggactcttgaggacctaaagcttgactacattgatttatatcttatgcattggccatttaggacgaagccgggttcaagaggttgggaccctgagattatggctcctttgtgtcttcctgagacatggaatgcaatggaaggtttgtttgcctcaggtcaggcacgcgcaatcggggtgagcaacttttcaactaagaagctgcaagacttgcttggatatgctaagattccaccagcagttaaccaagttgaatgtcacccagtgtggcagcaacctgcgcttcacaatttgtgcaagtctaccggtgttcatctcacagcatattgtcctttaggctctcctggatcatgggtaaagggggaaatcttgaaggaaccactgttgattgaaatagctgaaaagcttcacaagtctccagcacaagtggcattgcgctggggactccaaagtggtcacagtgttcttccaaaaagtgtaaatgaatctaggatcaaggagaaccttagtttatttgattggtgccttcctcctgagctcttctcaaaattatcacagatacaccagcaaaggttacttcgaaatgaatccgctgtccatgaaacttgtagtccttacaaaagtcttgaagaattgtgggatggagaaatatgaaatgcagattacttttgataaagctcaggatgtaatttgacattgaattcttattactgatataaaattacaaattgtaggaatgtttaaaatttgtattgtccgaagacaatcacccctctacggttttatgtgaatcctcacatatgaacaaaagaaaatttgaccgattctttaaaaaaaaa

SEQ ID NO: 226 - DNA, 1402 bp, Glycine max
tcgagtcagctactaggccccccccccgtgagatgttcatcacatcaaagccatgttatacatttcgactaatccttaaccttagataaattgacctcactttttcctaatcaagcttttgatgagtttaattttcataaactgttaatgtaaaatttttatattgtcaactaattagaaatcatcttaaatataacttttaaaagtaaatattacaaaacttaataatctaaccatatatcacaatctatgattggaatacagaataaaaaaaatcttttcatcgtattctaatttaatttagcttttaacatacttgagaacacttgtatatttaatttactatttggttataaagaagattttagcatgtaagaaagaaagataaaacctaaaacacactttggtgttgtataattctgttcagagtagtgaatttcctctggttgccttgagttttttaaccatacaggatcagtgactgtgcacctgaagatgtctcaaaggcactaactaggactcttgcggacatgcagcttgactacattgatttatatcttatgcattggccttttaggacaaagttgggttcaagaggttggaaccctgagaatatggctcccttgtgtcttccagagacatggaatgcaatggaaggtttgtttgcctcgggtcaggcacgcgcaatcggggtgagcaacttttcaactaagaagctgcaagacttgcttggatatgctaagattccgccagcagttaaccaagttgaatgccacccagtgtggcagcaacctgctcttcacaatttgtgcaagtctaccggtgttcatctcacagcatattgtcctttaggctctcctgggtcatgggtaaaggggcaagtcttgaaggaaccactgttgaaggaaattgctgaaaagcttcacaagtctccagcgcaagtggcattgcgttgggggactccaaagtggtcacagtgttcttccaaaaagtgtaaatgaatctaggatcaaggagaaccttagtttatttgattggtgcattcctcctgagctactctcaaaattatcacagattcaccagcaaaggttacttcgaaatgaatctgctgtccatgaaacttgtagtccttacaaaaatcttgaagaattgtgggatggagaaatatgaaatgcagattacttttgatgaagctcgggatgtaatttgacattgaattcttatttctgatgcaaattgtagaaatgttttaacatttgtattgtctgaagacaatcacccctctaccttggggttttatgtgaatcctcacatatgattatatgaacaaaaagaaaatttgacccaaaaaaaaaaaaaaaaaaaaaaaaaaaaaaaagaaaaaaaaaaaaaaaaagaattc

SEQ ID NO: 227 - DNA, 3553 bp, Glycine max
aattttgcgtccacacaggaaagcattttcagtccaatgaaggggtttgggccagaaaataaaaatagatccggaattttaacacaagatagatatccccccatagtatagaaaaacaaaagtaagagaaaaagggattcccagttgacaccattgctcactcaggtgaagtgtttgtgtgtgtgactgagaagagaaagaaaagaagaatcttttgctgtctgtctctcatatcacaactcacacctctcttttgcttgttgttttcaagggttaggatttttcttcattgctgttgagaaaagtttcttcctttcttgctcttctgttcattcgttcattcatcttttgggctagtttggcctctcttgagcttcttcgttcatcaaaggaaggactgtgaagtgaacaattaatagaagcctgcttctgcatcttgtccaccaaagcttatcatttggccatcatcaaaatggtttcaaggtcatattctaacttgttagatcttacttcttgtggctccccgactttcagtcgtgagaagaaaaggctccctcgagtggcaactgttgctggagtactgtctgaattagatgatgaaaccagcaacagtgtttgctctgatactccatcctcagtctctcaagagaggatgatcattgttggtaaccagcttccattaaaggcacacagaaaagacaacggtacttgggagttcacatgggatgaggactcacttcttttacagctgaaagatggtcttggggatgatgtggaaactatctatattggttgtcttaaagaagagattgagccaagtgagcaagatgatgttgctctgtacttgcttgacactttcaaatgtgtgccaacgttcctccctcctgagctttttagtaaattctatcatggattctgcaaacaacatctatggcctttgtttcactacatgcttcccctgtcacctgatcttggtggtcgattcgataggtccctttggcaagcttacctttctgtgaacaagatatttgcggataaagtgatggaagtcatcagccctgatgatgactttgtgtgggttcatgactaccatctgatggtacttcctacatttttgagaaagagatttaacagggtgaggctaggattcttcctccatagtccatttccttcgtctgagatataccgaacccttcctgttagggatgaacttcttagagctcttctgaattctgaccttattgggtttcatacttttgattatgccaggcatttcctctcctgttgcagcagaatgcttgggatttcttaccaatccaagcgtggctacattggccttgagtactatggaagaacagtaagcattaagattcttcctgttggtattcatataggtcagctccaatctgtcatgagtcatcccgagacagaaagcaaggttgcagagttaaaaaaacagttcagagatcaaactgtgctgctcggggtggatgacatggatatcttcaaaggaatcagcttaaaacttttggccatggaacaattgcttttacaacatcctgataagaggggcagagttgttctggtccaaattgctaaccctgcaagaggccgtggaaaggatgtgcaggaggtacaaagtgaaacttatgccacgatgaagaggataaataatgcatttggaaggcctggatacacacctgtagtcttgattgatacaccacttcagagttatgagcgaattgcttattatgtgattgcagaatgttgccttgttacagcagtgagagatgggatgaaccttataccctatgaatatatcatttgtagacaaggaaatgagaagatagatgagattttagggacagacctgcttactcaaaagaagagtatgctggtggtgtctgagtttattggctgctccccttcgttaagtggggcaattcgagtgaatccatggaacattgattctgtcgctgaagctatggattctgcgttgatggtcccagaggctgaaaagcagatgcggcatgagaagcattataggtatgttagtacacatgatgttgcgtattgggcacgtagcttcttgcaggatctggaaagggcatgtagagatcatctgaggaggagatgctggggaattggttttggtttaggcttccgagtgattgctttggatccaaactttagaaagctatctgtggaacatattgtttcagcttataagaggaccaagcaccgagcaattcttttggattatgatggcactatggtgcagcctgggtcgatgagtttaacacctaatgctgaagccgttagcatcttgaacatcttgtgcagggacaccaagaattgtgttttcattgtaagtggaagggagagaaagactcttactgaatggttttcttcttgtgaaaggatgggaatcgctgcagagcatggttattttgtgaggacaaatcgaaatgcagaatgggatacttgtattccagtacctgattttgagtggaaacagattgctgagccggttatgcagttatatatggaaacaactgatggttcaaacatagaggccaaagaaagtgctctagtttggaattacgagtatgcagaccgagactttggttcatgccaagctaaggagctttttgatcatctggaaagtgttcttgccaatgagcctgtttctgttaaaagtagtccaaacattgttgaagtgaaacctcagggtgtgagtaagggtattgtagcagaacgtcttctcttaacaatgcaacaaaagggagtgtttccagattttgttctatgcattggagatgacagatcagacgaggacatgtttggggtaatcatgaatgcaaaggcaaccctatctccagttgctgaagtgtttccatgcactgttggccagaaacctagcaaggcaaagtattatttggaagacacaagtgagattttgagaatgttgcaaggccttgccaatgcttctgagcactctactagaacttctttgcaaccagcttctcattaaggttctttttaatgtgtagagtgcaaacacacacacacacaatttggctacaatgtagtactatttttctatactatactgggatatctatcttgtgttagatttcgtgatctattttattttctggctgacttgccttcatttattgatatcccaactatgttgcaactatcaataggttgttttgaaagtagatgaattacatggggtactgtatttattgtttcttttcttgactattggtttgggccattttgatgtatgataaagtgatttttgattgggaatgaatgaatgctaggattgtgaatgtactgtatcaagtaacatcagaaaaaaaatttaagggcgtccgccgaaagctgtggacttgtggtcatataaatgttttaccgaggtggttcatttctgaatttatagtcctaatgttgcagagaagttttgtctcagttttgtgtcaatagattgctcacagattgtgcaattcacttttaatgtaaataattattattgggtctc

SEQ ID NO: 228 - DNA, 1695 bp, Glycine max
ggtcacggataagagcctggagctactttcgcgttctttcatgaatttcaagtctttggttcttgttagttgtgaagggttcaccaccgatggacttgcacccacgcgtccgaaatgtaggttccttaaggagctggatttgcaggaaaatgaagttgatgaccacagaggccagtggctaagctgctttcctgattgctgtacatcacttgtttctcttaattttgcttgccttaaaggacagattaatctgggggctcttgagagacttgtggcgagatctcctaaccttaaaagcttaaggttaaatcataccgtgcccctcaatgcactccaaaggatattgaggcgagcacctcaaatagtggacttgggtattgggtcatttatccctgatccaaattcaaatgtcttcattaagctaatgaacaccattatcgagtgcaagtcaataaccagtttgtcagggttttttgaggttactcctcgatgccttccagctatatatcctgttgtatgaacttgacagctatgaaccttagctatgcagcagggattcagagcagagagctaataaaactaatttgccgctgtgggaaacttcagcgattatggataatggattgcattggagactttggactacatgttgtggcttccacatgtaaagatttgcaagaactaagggtttttccgtctgttcgtgttggtagaaatgaccctgcaggagtcacagagaaaggacttgttgcaatctctatgggttgccctaagcttcactcattgctctacttctgccagcagatgacaaatgccgccctcataactgtggctaaaaactgcccaaattttatccgctttaggttgtgtatccttgacccaacaaaacctgaccctgatacagtgcagccactcgacgaaggttttggcgcaattgtgcagtcttgcaagcaacttcggcggttgtcactctccggccagctgactgatcaagttttcctttacattggggtgtatgctgagcagcttgagatgctgtctattgcatttgctggagaaagtgacaaggctatgctctatgtgctgaatggatgcaagaaacttcgcaaacttgagataagagatagcccttttggtgactccgcgcttctcatggacgtagggaagtatgaaacgatgcgatccctttggatgtcatcctgcgatgtcaccattggagcctgcaaggcacttgccaagaagatgccaggactaaatgtggagatctttaatggaaacgaaaaggtagatcgtgatgtggacgatggccagaaagtagagaagacgtatttgtatagaacactggttgggagaaggaaagacgcaccagaacatgtatggactctgtaggtgtgcattttggctatttaagttcttgttattaagctgtttcactagactggtcttacttactgattaatggaactttggtcaaggtcagtgataaaccaatcaactcaacaaaaaaaaaaaaaaaagagttctttaatggaaccgaaaaggtagctcgttatgtggccaatgcccaaaaagtaaaaaaaacgtttttgtataaaaccctggttgggaaaagaaaaaacgccccagaacatgtatggcctctgtaggtgggcattttggctatttaagttcttgttattaagctgttcccctccc

SEQ ID NO: 229 - DNA, 1724 bp, Glycine max
agaggttgatccagaggtttcctggtctaaagtctttgactttgaagggaaagcctcattttgctgacttcagtttggtgccttatgattggggtggctttgtgcatccatggattgaggcactggccaagaacaaggttggcttggaggagcttaggctcaagaggatggtggtctcggatgagagcctggagctactctctcggtctttcacacacttcaagtctttggttcttgttagctgtgaagggttctccactgatggccttgctgctttagctgcaaattgcaggtttcttagggagctggatctgcaagaaaatgaggttgaagatcacaaaggccagtggctaagttgctttcctgacaactgcacatcacttgtttctcttaattttgcttgccttaaaggagaggttagtttgggagcactagagagacttgtggccagatctccttacctgaagagtttaaagctgaatcgttcagtgccctttgatgcactgcaaaggataatgatgcgagcacctcaattatcggatttgggtattggatcatttgtccatgatccagaatcagaggcctacataaagcttaagaataccattctcaagcgcaagtccataaccagtttgtcaggatttttggaagttgctcctcattgtcttgcagcaatatatcctatttgcccgaacttaacatccttgaacttgagctatgcagcaggcattcagggtagtgatctgataaaactgattcgtcactgtgtgaaacttcagcgcttattgataatggattgcattggagacaaaggacttgatgttgtagctacttcatgtaaagacttgcaagaattgagggtgtttccatctgttccctttggaaatccagcagccgtcacagaaaaagggctggttgcaatatcaatgggttgccctaagcttcactcattgctctatttctgccaccagatgacaaatgctgcactcataacggtggctaagaactgcccgaattttatccgattcaggctgtgtatccttgatgcaacaaaacccgaccctgatacaatgcagccactggatgaaggttttggcgcaattgttcagtcttgcaggcgactcaggcgcctatccctctcggggcaattgaccgaccaggttttcctttacataggaatgtacgctgagaagcttgaaatgctgtccattgcatttgctggggagagcgacaagggaatgctctatgtgttgaatggatgcaagaagcttaggaagcttgagattagagactgcccttttggcaatgtggcacttctgacggacgtagggaagtatgaaacaatgcgatccctttggatgtcgtcctgtgaagtgaccgtcggagcctgcaagttgctagcgaagaagatgccgaggttgaatgtggagatcttcaatgaaaacgagcaagaagattgtagtctggaagatgggcagaaggtagagaagatgtatttgtatcgtacattggctgggaaaaggaaagatgcacctgaatatgtatggactctataggtgcattttttaggtcatttaatttcttgttattcagaagtttgtactttgcttttagggctgactgattaatgcaattttagccgggtgtagtgttttgtaacttgcattttgctagttttatacatatgctagattgctttttctcctaaaaaaaaaaaaaaaagg

SEQ ID NO: 230 - DNA, 1977 bp, Glycine max
tcgagtcagctacgtatggcccccccccccgagaggttagtttgggagcactagagagattattcggctcgagctcgagccgattcggctcgaggctgaatcgttcggtgcccgttgatgcactgcaaaggataatgatgcgagcacctcaactatcggatttgggtattggatcacttgtccatgatccagaatcggaggcctacataaagcttaagaataccattctcaagtgcaagtccataaccagtttgtctgggtttttggaagttgctcctcattgtcttgcagctatatatcctatttgcccgaacttaacatctttgaacttgagctatgcagcaggcattcagggaagtgctctggtaaaactaattcatcactgtgttaaacttcagcgcttatggataatggattgcattggagacaaaggactaggtgttgtagctacgacatgtaaagatttgcaagaattgagggtttttccatctgttccctttggggatccagcagctgtcacagaaaaagggctggttgcaatatcaatgggctgccctaagcttcactcgttactctacttctgccaccagatgacaaatgctgcactcataacagtggctaagaactgcccaaattttattcgattcaggttgtgtatccttgatgcaacaaaacctgaccctgatacaatgcagccactggacgaaggttttggcgcaattgtgcagtcttgcaggcgactcaggcgcctatctctctcggggaaattgactgaccaggttttcctttacataggaatgtatgctgagaaacttgaaatgctgtctattgcatttgctggggatggtgacaagggaatgctgtatgtgttgaatggatgcaagaagcttaggaagcttgagataagagactgcccttttggcgacatggcacttctgacggacgtagggaagtatgaaacaatgcgatccctttggatgtcgtcctgtgaagtgactgtcggagcctgcaagttgctagccaagaagatgccaaggttgaatgtggagatcttcaatgaaaacgagcaagaagattgtagtctggaagatgggcagaaggtagagaagatgtatttgtatcgtacattggctgggaaaaggaaagatgcaccagaatatgtatggactctgtaggtgcattttttaggtcatttaatttcttgttattcagaagtttgtacttgtttttaggctgactgaattaatgcaattttagccgggtgtagtgttttgtaacttccttgcatttgctagttttatacatatgttagtttgtcttttctcctagatattattattccataatgccactttttattacgtatattaatagagtattatactttttaaaaaaaaatgggattgttgaatcaatgcattagaagcttaggaagcttgagattagagactgcccttttggcaatgtggcacttctgacggacgtagggaagtatgaaacaatgcgatccctttggatgtcgtcctgtgaagtgaccgtcggagcctgcaagttgctagcgaagaagatgcctaggttgaatgtggagatcttcaatgaaaacgagcaagaagattgtagtctggaagatgggcagaaggtagagaagatgtatttgtatcgtacattggctgggaaaaggaaagatgcacctgaatatgtatggactctataggtgcattttttaggtcatttaatttcttgttattcagaagtttgtactttgcttttagggctgactgattaatgcaattttagccgggtgtagtgttttgtaacttccattttgctagttttatttttatgatagattaatttactcctaaaaaaaaaaaaaaaatgttttgtaacttccttgcatttgctagttttatacatatgttagtttgtcttttctcctagatattattattccataatgccactttttattacgta

SEQ ID NO: 231 - DNA, 2491 bp, Glycine max
agtcattccgaatgtttattccacagcaccaatcgactctgaatagaacaaaagaaaacaaggcataattccatcagatgcatcaacaaatcaggatgcactagaatataaatacgatttttattccttcccacggttaatgataacaagtccaccgatatcttactacgaaagagcaggggtaacatgcatataaaattatgcacaagtccataaaatattataataatgatacgaaaaatagtaactatcctatgcaacatagaacaaggttacgatctctatcagaattggtgtctcgtagctcagccaaagtgtaaaatgaatggcaatcgagctcaagcctttatatatcctcctgtaccttatagctcaaacaccaaccacaacagcataggccgtaaacagttttaattcattattgagtagcattctgggcatgtacctgcactaacaattctcacatcaaatgcttcataaattccacggctcattccacagcacaatcactcaagaaatccttaatgcagaatcatcttgcattctccatacatagcctggcatgtccaatcttggcccagaaacagtcctgtatatgtataacttctcaacaggactactctccggccttgaatctggaggtcctctttcatcaatgacttcaacattaagtcttggcattttctgacccagcaatttacatgctccataactcaccaagcaagaggacatccaaagggatcgcattgtctccagctttgcagcattggccaaaagggctttgtcaccaaaggggcagtccctgatctccagcttcctaaggttgtcacacccagacagcacatgatggagtcccaaatcgctatctccagcaaaagccacagaaagcatctcaagcttcttaccataagtcccaatatactcaaaaacacggtcagttagaagcccagaaagggaaagtcgctgaagatccttgcaatgctctacaatagctccaaaaccagcatccagaggttgatgggtgagatagtcaggagctcgaggctcaataatacatagtctaaaacgtgtcatattaggcctgctcctggcaattgtatctaaggcagcattagacatttgccgacaaaaatatagaactgactggagcttggtgcagccttcagacaccgaaacgaggccctgctctgtcaatgctacatttggttctaacccaaacgggtcagacggaaacaccctcaactcccttagatccttacaggatgcagcaatcacttcaaggccagcatcttctatgtaatccagcacccataaccgctgcaaactctcacattgaccaacaagcttgataagatcagggctttgaatagttgcataactcaagttcagtgaagtcaggttggagcaaataggatagacagctggaaggtaggaagggagcacgtcccaaaatccagataagcccttcaattgcttgcacccagaaaatgcctccgcaaggtttgtgaagacctccggtcgcatctctgtcgtgtaagctccggtgcccaactcaaccaactgaggagcaccgcgaagaagagtggcaagcctgtctagtggcacagcacggttgaggcggagcgtctggagattgggacacctactaaccaggcgctctagggcagacaaattcacctcattgcctaagcaagaaatgttaagggaaaccagtgatgtgtacgaatcaggaaaatggctcagccaatgcccacagatgtcgtccacctcactctcccgcaactccaactccctcaaattcctgcaattggcagcaatggcagcaagtccgtcagtggtgaatccctcgcaagaggtgagaaccaagacttgaaagttcttaaacgatttggcgatgagttccaagcattcgtcggagataaccatcctcttgagcctgatctcctgaagccaggggtaggcagcggccatggccttgatccaagggcccacataagcgccccaaccctcggggaccaaattgaagtcggcgaagtgcggcttccccttgatggcgatggatctaaccttggggaagcggttgacgacggtggccggagagacggcgtagcagtttccgacgaagactctccggcgacaccagcgctcgatctcgtaccaggacttgcagacgagggagatcgagcctcggtccttgtcgcactcgatgaaggagaacacgtgctccagcacctcctcggggaaggagtaatttactctcggccgcatgtccaatggaatacaacaaccctaccaaaaacgctgtcgttttccgaatgaagcagtagtgaaagctcgcagtaaagcagcagcgcttagagagttagatctgagaagacaccatcggaagagcgaagagattgtgttattgtgaactagttgttgatgtgtgaagttgccagagagagaagagagagagagagagagagaaggataaggagtttgtgttgtc

SEQ ID NO: 232 - DNA, 2405 bp, Glycine max
actccttatccgtctttctctccctcacatcacacatcacacatcacacaaacagagacacattattattacatactaccactctcgtagtctcgcttggtgttaatggcgtttcagatctaacagtgcaagtggttcggcgtggttgttagtgagttggttaagcgacggcgtttggttggggttagtattatgcagagaatggcgtacacgttttcgtttccggaggaggtgctggagcacgtgttctcgttcatatggaacgagagggacaggaacgcgatctcgctggtgtgtaagtcatggtacgagatcgagaggtggtgcaggaggaaggtgttcgtggggaactgctacgcggtgagccctctgatggtggtcaagcggttcccggaggtgagatccattgcgctcaaagggaagccgcactttgcggacttcaatttggtccccgatggctggggaggttacgtctgcccctggatcgccgccatggctcgcgccttcccctgcctcgaagaaatcaggctcaagaggatggtcatcaccgacgagagcttggaactcatcgctaagtccttcaagaacttcaaggtcttggttctcacttcctgtgagggttttaccactgatggacttgccgccattgctgccaactgcaggaatttgagggaattggacttgcaagagagtgaagtggaggaggaccttagtgggcactggctaagccattttcctgattcctatacgtcattagtttcacttaacatctcttgcttaaacaatgaggtgagtttatctgcgctagagcgtctgcttgggaggtgtcccaacctgcggaccctccgtctcaatcgtgccgtgccccttgatagactacccaacctacttctccagtgtcctcagctggttgagttaggcacaggagtctactcaactgagatgcgaccagaggtcttctcaaacctggaagcagcattttctggctgcaagcagttgaagagcttgtctggcttttgggatgtgctcccatcctaccttccagctgtctaccccatctgctcaaggctaacatcgctaaacttgagttatgctattattcaaagctctgatcttattaagcttatcagtcaatgcccaaatttgttgcgattatgggtgctggattacatagaagatgctggtctttatgcccttgctgcatcatgtaaggatctaagagagttaagggtgtttccttctgacccatttggtttagaaccaaatgttgcattgacagaacagggccttgtctctgtgtctgaaggttgccccaagctccaatcagttctatatttttgtcgtcaaatgtcgaatgcagccctacatacaattgcgcggaacaggactaatttgactcgttttcggctttgtattattgagcctcggactcctgactatctaacccatgaacccctggattctggttttggggctattgtagagcaatgcaaggatcttcaacgcctatccctatctggtcttcttactgaccgtgttttcgagtatatcgggacttgtggtaagaagctggagatgctatctgtggcttttgctggagatagtgatttgggacttcatcatgtgctatcagggtgtgataatcttaggaagctggagatcagggactgcccctttggtgacaaggcccttttggcaaatgctgaaaagctggagacaatgcgatccctttggatgtcctcctgctcggtgagttatggagcatgtaagctactgggtcagaaaatgccaagactcaacgttgaagtcattgatgaaagaggacctccagattcaaggccagatgattgtccagttgagaagctttatatatacaggactattgccgggccaaggttggacatgcctggttttgtgtggacaatggaagatgattcttcactaaggcttgagtgatcacgctgtggattgagccaaggaaatctaatgccactttggtttctgacatcgataatggcaggtacatgctcagtatgcaattctctagtggatttactgttgcctggcttatatatatagttagttacggcttttggttgagctaggtaaaggagagtactcagaaggcttgagctcgattgccattcattttacactttggctgagctatgggatgccaattttactgataaataaagagtctgaaaccgtgttgttgtatgtgcgttagatacagttgttatattattcttcatactataatatttgcgggcttcaatttatttgtatgttaactttctctttcgtattaggatgttggacacatttgtcattgtcacttgttagccttcccaatgaataatgttcgtattctaatgcagccagcgttattagctcttcgcaaa

SEQ ID NO: 233 - DNA, 2893 bp, Glycine max
cccacgtgctttcacttcaccaccaccttctcctttctccttcttcctcctcctttctgcttcttcattctctccttccctcttgagcttttctttttagcacggaacatgtgagtgccacaaagggtttgagactttttgaggctttctctcactctaataagtcctaacctcattcacctcttgggtggtgtggtctataatgtaatttatcatttgtgcaaattttttctcagatctatccaacttctcttttttgtccttttattctgtttggaaatcgtcatcatcaccatttgatttgcagggccataatttttctgctttggttttcaactcttccacaccattttccattttttcttcttcttcttctctggtttttttttttcctgtgaaaaaaaaattgagttctttttggctaagcctccaagcagatccaactagggaaatgtaaaattttcaattttttttatcagtatcctctttccagaccttcccctcatgttctagatttgaagatcttgtcattgcctcactcttgtttgtgccaagatctgttctgttccgttccccccctttttctttttttagatcttggtcttctccatgatgtagtagaacttcaaatttgaaagctttacctttctgagattgctttttttttttttctatccccttccccttttggagtatgaaaattttcctggaaaattagtgagctaggatcactgagtgagagaaaagaaaaaaaaagatgatgaattatttcccggacgaggtaatagagcacatatttgactatgtggtgtcacacagtgatcgaaatgctttgtctttggtgtgtaaaagttggtacaggatagagaggtgtacgaggcaaagggtgttcatagggaactgttactccatcactccggagaggttgatccagaggtttcctggtctaaagtctttgactttgaagggaaagcctcattttgctgacttcagtttggtgccttatgattggggtggctttgtgcatccatggattgaggcactggccaagaacaaggttggcttggaggagcttaggctcaagaggatggtggtctcggatgagagcctggagctactctctcggtctttcacacacttcaagtctttggttcttgttagctgtgaagggttctccactgatggccttgctgctttagctgcaaattgcaggtttcttagggagctggatctgcaagaaaatgaggttgaagatcacaaaggccagtggctaagttgctttcctgataactgcacatcacttgtttctcttaattttgcttgccttaaaggagaggttagtttgggagcactagagagagttgtggccagatctcctaacctgaagagtttaaagctgaatcgttcggtgcccgttgatgcactgcaaaggataatgatgcgagcacctcaactatcggttttgggtattggatcacttgtccatgatccagaatcggaggcctacataaagcttaagaataccattctcaagtgcaagtccataaccagtttgtctgggtttttggaagttgctcctcattgtcttgcagctatatatcctatttgcccgaacttaacatctttgaacttgagctatgcggcaggcgcccccgcgagtgctctgcggacccccccccatcactgtgttaaacttcagcgcttatgggtaaatctatcaaattcaaatcttttttctgttatatttgttgattcttatattggtgaatatcaataaattttagacttgtgcagataatggattgcattggagacaaaggactaggtgttgtagctacgacatgtaaagatttgcaagaattgagggtttttccatctgttccctttggggatccagcagctgtcacagaaaaagggctggttgcaatatcaatgggctgccctaagcttcactcgttactctacttctgccaccagatgacaaatgctgcactcataacagtggctaagaactgcccaaattttattcgattcaggttgtgtatccttgatgcaacaaaacctgaccctgatacaatgcagccactggacgaaggttttggcgcaattgtgcagtcttgcaggcgactcaggcgcctatctctctcggggaaattgactgaccaggttttcctttacataggaatgtatgctgagaaacttgaaatgctgtccattgcatttgctggggatggtgacaagggaatgctgtatgtgttgaatggatgcaagaagcttaggaagcttgagattagagactgcccttttggcaatgtggcacttctgacggacgtagggaagtatgaaacaatgcgatccctttggatgtcgtcctgtgaagtgaccgtcggagcctgcaagttgctagcgaagaagatgccgaggttgaatgtggagatcttcaatgaaaacgagcaagaagattgtagtctggaagatgggcagaaggtagagaagatgtatttgtatcgtacattggctgggaaaaggaaagatgcacctgaatatgtatggactctataggtgcattttttaggtcatttaatttcttgttattcagaagtttgtactttgcttttagggctgactgattaatgcaattttagccgggtgtagtgttttgtaacttgcattttgctagttttatacatatgctagattgctttttctcctagttattattccataatgccactttttactacgtatattattagagtgggtatttcgccttttatctaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaa

SEQ ID NO: 234 - DNA, 1576 bp, Glycine max
  misc_feature (1562)..(1562): n is a, c, g, or t
ccacgcgtccgggaaaatgaagagagaggagaattgagttgggttgggggcatggaagaagaagaagaagggcttgccatgctcatcactcaccttcaccatttctctcactctctttctcctctcttttttacccttcaccctcctctactctctcatcaactccccagattgtccttctttgacattgatgattactccttagatgacttctgtggccttgtaatggcagctggaaagtcttggaagtccaggatgttggagcctctaaagcatccatctaagaagtctcgaagagataggagccttggaaaatcatctggaaggtcctccagggatgaagctatggaacaacaaatttggaaaaaattgcctgaggatctatttgagcctgtgattgcacgacttcccattgccacatttttctgcttccgctctgtatgccagcgatggaattccttgctgacttctcaaagtttttctcagcattgtgctcaagtcccacaagcaaacccatggttttacaccgtaactcatgaacatgcaaattccggagccatgtatgacccttctatgaaggaagtggtatcatcccactatatcaacactgcccgcagagttgatagttttgccagtggcttctgcagggggtctagtttgctttcttgacatttatcgtcaaaatttctatgtttgtaacccattgactcaatccttaaaggagttaccagctcgttcagttagggttgggtctcgtgcgtctgtagggatgacagtaaatggaaactcaactagtgctggctacaagatcctattagttggttgtgatggagaatatgaaatttatgactcagtgacaaagtcttggagccatccagaaaacatgcctgcagatattaagctcccgctgtcactcaattttaggtcacaggccgtttctattgacagcaccctgtacttcatgcattcagatcccgaagggattgttttgtatgatatggcaactggggtttggacgcagtacataatcccagcaccattgcatctgactgaccacatgctggctgagtgcgatggccggatattgcttgtggggttgctcacgaagaatgcagccacatgtatatgcatatgggagctgcagaagatgactttcttgtggaaggaggttgacagaatgccaaacgtctggtgcttggacttttatgggaagcacgttagaatgacttgcttgggaaacaaaggcttgctgatgttatccttgagatcaagacaaatgaatcgattggttacttacaacatagcaagtagggaatgggtgaaggttcctgcgtgtctggtgccacatggaagaaaacgacaatgggtagcacatgatggaaaacgatacgaagttgtacttcttaatgtattctttatgctctcaggcatgctacctagtcacccttgtttcaagactgtttcctgtatatggaaagtgtcaaggttaaattacagttagtatcgttcgtcgttgacagctgagaggctcaaactggggactgcttgtcctgctaaaactntagacgttggccct

SEQ ID NO: 235 - DNA, 1893 bp, Glycine max
acttagatgacttctgcggcctcggaacggctgctggaaaggctggaagttccaggatgtgggagcctctaaagcattcatctaagatgtctcgaagagataggagccttggaaaccacgcgtccggcatgttagttgcgtgggtggcaacgtggaaaaacaagagtgggtaagaatagggaattagggagagaaggataagagagagaaaacaggaggagcaggaatcaggcatggaagggctggccatgctgaagcagctcattgctcagcttcaacacctctttgacacttaccactctcaatcttctctcatctttcaacaacaacaccccagatggacgacctcccttgacattgaagataactctgtagatgacttctgtggccttgtaatgacagctggaaagtctggcagtttcaggatgtcggagcctggaaagcctccacctactaagaagtctcgaagagatagaagcaggggcaaatcatctggaagatcttgtacaactgaagttatggaacaagaaatttggaaagattttcctgaagatttatttgaggctgtgattgcacgtcttcccatttccacatttttccgcttccgttctgtctgccggcagtggaattccatgctgaattctcaaagtttttctcagcattgtactcaagtcacacaagaaaatccatggttttacaccattacccatgaaaatgtgaattcgggagccatgtacgacccttctttgaaaaaatggcatcatccaactatatcaacaccgcccacaaaattgattgttttacctgtggcttcttctggcggcttagtttgctttcttgacattggtcatcgaaacttctttgtttgtaacccactgactcaatccttcaaggagttgccagctcgatcagtcaaggtctggtctcgtgttgctgtagggatgatggcaaatggaaactttgctggttcaggctacaagatcgtatgggtaggttgtgatggagaatatgaagtatacgactcagtcagaaattcttggagtcgtccaggaaacatgcctgtgggcatgaagctgccattgtcgctcaactttaggtctcaagctgtctctattggcagcacactttatttcatgcgttcagacccagacgggattgtttcctatgatatggcaactggggtttggaaacaatatataatcccagcgccactgcatctgactgatcacactctggctgagtgtgatggccaggtcatgcttgtgggtttgctcacgaagaatgcagccacttgtgtatgcatatgggagttgcagaaaatgactctcttgtggaaggaggttgacagaatgccaaacatatggtgcttggacttttatgggaagcacgttagaatgacttgcctggggaacaaaggcttgctcatgttgtccttgagatcaaaacaaatgaaccgattggttacttacaacatagcaaagaaagaatggctgaaggttcctgggtgtgtcgtgccacgtgggagaaaacgacagtggatagcatgtggtactgcatttcatccatgcctgactgcggtggtgtgatttctcatctatctctaacagcaatggcctagcaacggcctgccatttcccccctccagtcttgtagttcttttgcaatttgcaggcctttggtgttgctgtaggtaatcctaatgttcattgctggtgtaacaaagtagatgaaaaataatatgggtttgtagtgattcacgttttttcatgctctcagacatgtaaacattactttggttttgttatgaatgcctcatcctgggaacaccttggtaaaaggtgatataaaactgccgttcttttctgtattcagagtgtgagtggtttttttctt

SEQ ID NO: 236 - DNA, 2585 bp, Glycine max
  misc_feature (1853)..(1853): n is a, c, g, or t
agtgaacgactatcaactgaattaaccaattgaatcactcattaatcgataataaacaactaacctcactaacaaatagttttagcctcaacaaaagcaaatgggtaatttttcctttttaaaatcatgtaatactctcccaaggtggaatgctaacctcaatcttaagataccattgaaattgaagcggaacgttactgaaagatttaatttaacacgtgtggctgtgaattgagtgctagtacaacactaataataacgctgcataccaaccacagaaacaaacaaaaaaatccagctggcagataagaaacaacaacaaacaacagcaacagagcacgccttgcgttgcatggtgccgacgcggcgcacgttagccgagttgcacgaatccctacatataaaacacaccgtttcgctgtactgattttttttgccactctgctgcagtgctgcttcatactttttctcgcctataaaatgtccgccactgcttcactctgcgccacttccagaacaactttctcatcatcgaagcccgtcgcgagaagaagctgcttcgtcgcggttcccaaaatcgcgtttcccaagctccgtttcaaacccgtcgctatggctacgctcggcgctcgcatggtggccgccgcacccaccgtcactccgccggcctcgctcgacttcgaaacctccgttttcaagaaggagaagattaacctcgctggacacgacgagtacatcgtgaaaggagggagggatttgttccctctgttgcagggtgctttcaaggggattaagcagattggcgtcattggatggggttcgcagggacctgctcaggcacagaatttgcgggactcgcttgctgatgcaaagtctgatattgtggtcaaggttgggctcaggaaaggttctcgctcctttaatgaggctcgcgcagctggttttagtgaggagaatggaactttgggtgacatatgggaaactatctcaggcagtgatcttgtgttgctcttgatttctgatgctgcacaggctgataattatgaaaaaatattttcccacatgaaaccaaatagcatactgggtctgtcccatggttttcttcttgggcatttacagtcaataggacttgattttcccaagcacttcagtgtaattgctgtctgcccgaaaggtatgggtccttctgtcaggaggctgtatgtccaaggcaaagagataaatggtgctggaattaattcgagttttgcagtccaccaggatgtggatggcagagctactgatgttgctttggcatggtctgttgcccttggttcgccttttacatttgcaacttcgttagagatggaatacaggagtgacatctttggggagagaggcattttacttggtgctgttcatggtattgtggaatccttgtttaggaggtacactgaacatggaatgagtgaagatttggcctataacaacactgtcgagtccattacaggaactatatctaaaataatctcgactaagggtatgttggctgtatacaatgctttatctgaagatgaaaagagggaatttgagaaagcatatagtgcttcatattatccatgcatggacattttgtatgagtgctatgaggatattgctgctggaagtgagattcgcagtgttgtcttggctgggcggcgcttttatgagaaagagggtctgcctgcatttcccatgggtaaaattgatcagacccggatgtggaaggttggtgagcgtgtccgttctacaaggccagctggtgatctaggtccattatacccatttactgctggggtctacgtggcattgatgatggcccagattgagatcgnctgaggaagaaggggcgattcttacctctgaaattattaaccgagagtgtcattgagtctgttgattctttgaatcctttcatgcatgctcgtggtgtttcattcatggttgataactgttcaactacggcaaggttgggttcaaggaaatgggctccccgatttgattacatcctaacccagcaggccttggtggctgtggacaatggagcacctatcaaccaggacctaatcagtaacttcctgtcagaccaagtgcatggagccattgaagtttgtgctcaactgagacctacagtagacatttctgtgccaccagatgcagactttgtccgtcccgagttgcgtcagtctagcaattagaacttgaaccaaattcttgagcctattcctttttggaatgcttagaatagcagctgtcctgttggtttgaattttgttcatatggttgagtgctgtgctgtggaagtctgtattatcactatgtagtactgagattttaataatggggaatgttgcttaatgtgaattagaaatgagttaataagacaagtgaagttcattactaggtttcaaaaaaaaaaaaaaaaaaaaaaaaaaaaaaaaaaaaaagaaataaaacaaaaaaaaaaaaaaaaaacaaaaaaaaaaaaataaaaaaaatataaagataaaaaaaaagaaaaaaaaaaataaaaaattatggggggggccgttttaagggatccaagt

SEQ ID NO: 237 - DNA, 2099 bp, Glycine max
aagaaaggaaatctaaaatccccgttcgatctcacggagacggacctctctctcgcgcggacgcgttgctgtagctcgctcactctcagactctcgcgcaacccccctctcgtggacgcgttgttgcagatcctcgttcgttctcgctctctcgcgtgagtttttgaatttgttggtctatgtgcaggaccagccccgaactcctgctcaatccctgtggatcagcttgcatcgatttatccctggaagaaagtaaacaaaatcctgtagaatagctctttgtggcttttaaattgaatcgaggatgggagacgaagcaagtgaagagcatcaaaggtcgctagcagctcctttcatatttttcgtggttctcgcatttcagtttgcttctcattggattgatcactttaagaagagtggatctgacaaagaaaaagaaactaagttgcgtggagaaataaaagagcttttgaaggaggcaagctcactgtcacagccatcaacctttgcacaagcagcgaaactcaagagactggcagctgcaaaggagagggaactggcaaagtgtcaaaatttacatcacaaggatgatgctttgtattcaaaagttctgctcatctcaaaggttttaacatatttaattctgcttatctggttttggagtgttcctgtctctagcatatctcaacaacttgtgcaaccatttgggagattattatcttggaggactggaggggttcaaaatagcaatattatggttgggataataccttggctgatagtgtctaccagggttagcagatttatttgtagactcacctatggcaaatagattgtcatgatattcaattcttcatctagaatgacataaaattgctagctgcttgggttggtatcctgcatttaaagtggaagggacatatgaagcatcttgaaattcgttctttcgctccatgtctggttgataagttttttgagtttcattttattttagtacagacgtgtaagatccattctgcatatgcaagcaaaatttcatgcttgtaatatgatagcattaagtctcttacaacctccaccctcagttttggtctttattaaggaaatttgtctttaaatgcttatggattaatcatatttatttattcatttataaaaaaaaaaaaaaaaaaaaaaaaaaaaatgaacagtttatcaatggcacttctccacgaaagtgaggcaggttccttatcttgttggctttgactcaaaagctgtgtgtggcatcagaaaatgaacagtttatcaatggcacttctccacccaaatcttcttcccactttcaattccaacactcttacctttccttccatcaaactcaaaccctcactctcgcacgtgccttctccaacccccacacgcttcagtctctctgtttccgcggcggaaaccaccgcttttgccgcccctcccactccccaacctgagaagcttggagttgtagttaagccaacggagaagccgagacttgtgttgaagttcatatggatggagaagaacattggaattgcgcttgaccagatggtaccgggccatggcaccattcctctgagcccatattacttttggccccgaaaagatgcctgggaagagctcaaggagttgcttgagaacaagccttggatctctcagaagcagatgattattcttctcaatcaggccactgatatcatcaatttgtggcaacagagtggtggcaacttatcctgaactcattcatgtgccaacatatttcaatgatgtttttccttttcatgttatgtttttctcttgtactgcattttcggctgtgctcttcctctttctatgtatgcctggcatgtgcttgattattattactatcaactaatccataaattctttctcgtgattcattaaaaaaaaaaaaaatttcctgcagccccgggggattcccctaatttctaaaagcgcccgccacccgcggggggaacctccacacttttgggtccctcttaagggagggttaaaatttccaggcttgggcgaaaatcatgggaccaatagctggtctccctggaggggaaaatttgatatac

SEQ ID NO: 238 - DNA, 686 bp, Glycine max
acgctgaaagatcagaatgggaagaatgtgagcctctccaacttcaaaggaaaaccagtaattgtgtatttctaccctgctgatgagacccctggctgtaccaaacaggcttgcgctttcagggattcatacgagaagttcaagaaagcaggagcagtggttgttgggataagtggtgatgatgctgcctctcacaaggcatttgccagcaagtacaggcttccatttactttgttgagtgatgagggtaacaaggtgaggaaagaatggggagtgccaggtgatttctttggatcattgcctggaagagagacttatgttcttgacaaaaatggggtggttcagctcgtctacaacaatcagttccaaccagaaaagcatatcgatgagaccctcaaaatacttcagagtctttgaggattctgattcttttgtttgctatctcagctggcttgattcagagtcagacaagtatgtaactatgaattgtaagtttgtaatcactgtaattatgtagctgattttggagcctttgatcacattcacatgggggtgatgatgcctctccagatggaaataatgccttcatttgccacaaatacagtcagattatatatgtatcttttgcacatcgtaagtttagcttcattgacaagtaaccatccttatatttctaaaaaaaaaaa

SEQ ID NO: 239 - DNA, 1014 bp, Glycine max
aatgagaagctggttcacagtcttctagtccacttgaaatcaaaagaaccaccaatggcctcttcaatatccctcttcctcctccctctccttcttcttctctcacacgcttcagaagcttcaacggtaatattctacaacaagtgcacatacacagtctggcctggtatccaagctagctccggtcagccgctactcggcggcggcggattcaaactttctcctaaaagagcttacactctccaacttccatcgctttggtctggtcggttctggggccgccacggttgctccttcgatagatctggccgtggtcgttgcgccaccggagactgcggtggttctctcctctgtaacggagccggaggtgtacctccagctactctcagagatcaccctcggccatgaccaggacttttatgacgtcagcctcgttgatggatacaacttagctatgtcgataatgcctgtgaaaggcacagggaagtgcacctacgcaggttgcgttagcgacttgaacagaatgtgtccggttggtctacaagtccgttcacgtgatgggaaacaggtagtagcctgtaaaagcgcatgttctgcctttaactcaccacgctactgttgcaccggttcgttcggtaacccacagacgtgcaggcccacggcttactccaagatcttcaaagtagcttgtcctaaggcctactcctacgcttacgatgaccccactagcattgccacgtgtaccaaagctaactacgtcgtcactttttgcccccaccgtggccgttgattaagatcttagcattaaatataattaagaataaatttataaatttactctgttatttggcacgaggtttcttttgagttattaagacttttccagcttaatgacgtaatttactgctttccgatttattgttctatctatttttttcgttcatctagagctaatcacatgagatttcatccaatcgttattaagactttttcagattaaaaaaaaaaaaaaaa

SEQ ID NO: 240 - DNA, 2072 bp, Glycine max
  misc_feature (1897)..(1897): n is a, c, g, or t
ccacgcgtccggaaaaatattaagaaagaaaataatcaatacgacaactttgcaattttggtggtacgaccaaggtaggtcaattgccatggacattggtggtgaagtggaagagaccgtgagagagttgaggcaatacttcaaaactggaaaaaccaagagtgtgacatggaggaaaaaccagctcacagctctcttagaccttgttcatgagaatgaagatgctatatttaaggccctccatcaagatcttgggaagcaccctgttgaggcttaccgtgatgaggttggaggggtagaaaaatccgccagcaatgctttgagctgcgttgagaaatggatggcccctaaaaagagtgatatcccttttcttttcttcccagctaaaggagaagtgttgtcagaaccacttggtgtggttctcatattttcttcttggaacttcccaatcatactgacattggatccaataattggggcaatatctgctggaaatgttgtagtcataaaaccttcagagcaatctccagcaagctcttcttttcttgccactaccattcctcgctacttggactctaatgccatcaaggtgattgagggaggaccagatgtctgtgaacaactactgctacaaaaatgggacaaaatattcttcactggaagtccacgtgtggcaagcgtagtcatgtctgctgctgcaaagaatttaactcccgttactctagagttgggtggaaaatgccctgccattcttgattcccttccaaatcctttagagagtaagttggcagtaaaaagaattgtaggaggaaagtggggaccttgcagtggtcaagcttgcatagcaatagactatttgcttgttgagaagaagttcccatatgctctgatagaattactaaagaagatcattagaagattttatggtgaaaatccagtggagtcaaaggtaatttcaagaatattaaacaagcagcactttgaaagattatgcaatcttctcaaagaccctcttgttgcggcttccatcgttcatggtggttcagttgacgaagaaaacttgttcattgagcctacaattttgttagatcctccactagattctgagataatggcagaagagatattcggcccactgcttcctataatcacattggataaaattcaggaaagtattgagtttatcaatgcaaagccaaaacctcttgccatttatgccttcaccaaagatgaaactttcaagagaaagattctatcagaaacatcctcaggaagtgtcgtatttaatgacacaatggttcaatttttatgtgatacactaccatttggaggtgttggccagagtggttttggaaggtaccatgggaagtactcttttgacactttcagccatgaaaaagctgtaatgcatagaaagctgttccttgaaattgagccaaggtaccctccttggagtaagttcaagctcgagtttatcagattggcatacaggctgaactactttggactattactgcacatgctgggcttgaaaagatacaagtagataaatacctcagcacagtgttcatctattcctcaaatacacgttgattaaaaaagaattaagctttattgtgactgaatatgagttgtaggaaaataggagaaagggtccttatttgcagaagttgcacatgtggtgaactttaacttggcgttgtaataaacgaacctttgtatctcttatttttcttgctagtaataggatgtttttacttctaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaataaaataaaaaaaaaaaaaaaaaaaaaaaaaaaangggggggccctttttaagggtccaaagtttacaaccccgggatgggaaaaaaatattttttttttggggccaccaaaataaaatccgggggcggggttttaaaaacgggtgggaggggaaaacccgggggttcccccaaataattcccttgggaaaaaacccccttttcccaggg

SEQ ID NO: 241 - DNA, 3575 bp, Glycine max
aaggctggggatttgatacgtaagtggattgtccatccattatcatttatcaatctgcactctgcactctgcactgagaagagaagcagtgatggaaagggcggcactggttcgttgtctgccgtgctcttctgtgttgtgcagaagatatttacactctcactcacacttgtgtcgtccctcttcctctattagtattattccctctctctcccttccaaccataaggcctctctgtctgccccgccgccgctcctcctcctcctccagattgcttcccctttacttccgtaccaccatcaacaggaaacacttctcttctctcgccccgagagctgttctctccccttctccttcttcaggttttgctgaggttaatgatgaagttgcccttaaattggggtttgagaaagtttccgaggaattcattccagaatgcaaatcaaaagctgttcttttcaggcacatcaagaccggggctcaagtcatgtctgtttccaacgacgacgacaataaagtctttggaattgttttccgcactcctccgaaagactccactggtatccctcacattctggagcatagcgtattatgcggctcacgaaaataccctctcaaagagccttttgttgaattgttgaaaggaagcttgcacactttccttaatgcgttcacctatcccgataggacatgttacccagttgcttccacaaatgccaaggatttctataatttggttgatgtctacctggatgcggttttctttcccagatgtgtcgaggactttcagatttttcaacaggaaggctggcactttgagctcaacgatccttccgaagacatcacttataaaggtgtcgtgttcaatgagatgaagggtgtctactctcaaccggataatatacttgggcgagctgctcaacaggctcttttcccagacaccacctatggtgttgacagtggaggtgatcctcgagttattcccaagttgacttttgaggaatttaaggaatttcaccgcaagtattaccatcctagcaattcccgcatatggttttatggagatgatgatccaaatgagcgcctccgcatcctaagtgaatatttagacttgtttgattctagtttggcctctcatgaatcaagggttgaaccacagacactattttcaaagccagtccggattgttgagacatatcctgctggtgaagggggtgatttgaagaagaagcacatggtctgtcttaactggttgctctctgataagcccttagacctggaaactgagctaacactaggatttttgaatcaccttctgttgggcacccctgcttcaccactgaggaaaatattgctagaaagtagactgggcgatgccattgttggtggtggggttgaagatgaactactccagcctcaatttagcattggaatgaagggtgtttctgaagatgatattcataaggtagaagagctggtcacaagtacacttaaaaagttggcagaggaaggttttgatacagatgccattgaggcttctatgaatacaattgaattttctctgagagagaacaacactgggtcatttcctcgtgggttgtctctcatgctccagtccattggtaaatggatttatgatatgaatccctttgagccactgaagtatgagaagcctcttcaagacctaaaatctagaatagcaaaggagggctctaaatctgtgttttctcctctaatagagaaattcatcttgaacaaccctcatcaagttaccgtggaaatgcagcctgatcctgaaaaagctgctcgtgatgaagtcgcagagaaacagatattgcagaaagttaaagctagtatgacaacagaagatctagcagagttggcccgtgctactcatgagcttcggcttaagcaggagactcctgacccacctgaagctttgaaaactgttcctagcctttctctacaagatattcctaaagaacctattcgtgttcccactgaggttggggatatcaatggagtaaaagttttgcagcatgatctcttcaccaatgatgtcctttacactgaaatagtattcaacatgaaatcattgaagcaagagcttcttccattggtgccactgttttgccaatcattgttggagatgggaacaaaggacctgacttttgtccaattaaaccaattaattggaagaaaaactggaggaatatcagtttatccattcacatcatcagtgcggggcaaggaagatccatgtagtcacatggttattcgaggcaaagccatggctggacatattgaagacctttatgacttggttaattctgttcttcaagatgtccaatttacagatcaacagcgtttcaaacaatttgtttcccagagtagagcaagaatggagaaccggttaagaggaagtggtcacggaattgcagctgcaaggatggatgcaaaactaaatgcagcaggttggatgtcagaaaagatgggaggtctcagttaccttgaattcctccgaacacttgaagagagagttgatcaagattgggccgatatctcatcatctcttgaggagatccgcaaatctatattttccaagcaaggctgcttgataaatgtcactgctgataggaaaaaccttgcaaagacagaaaaagttctgagcaaatttgttgatctgcttcctactagctctcccattgcaacaactacttggaatgttagacttccattgacaaatgaagctatcgtgattcctactcaggttaattacattggaaaagcagccaacatttatgatactggttatcggcttaatgggagtgcatatgttatttccaaatacattagcaatacatggttgtgggatcgtgtacgtgttagtggtggagcttatggaggtttctgtgattttgatactcactcgggagtgttctccttcttatcttatcgtgatcccaatttgctgaagacacttgatgtatatgatggaactggtgacttcttaagagaactacaaatagatgacgacactttaacaaaagccataattggaaccattggggatgtagatgcgtatcaacttcctgatgccaaaggttatagtagtatgttgcggtacttactgggtatcacagaggaagaaaggcaaaggagacgtgaagagatattatctactagtttgaaggacttcaaaatttttatggatgctatggaagcagttaaggataaaggggttgtggttgcagtggcatctccagaggatgtagatacggccaacaaggaccgtcccgacttctttcaagtgaagaaagccctttagtttcagtatctattccccgcatggatttgaaattgtatcttttcttaaaatttcatacatcgaaacaaatgtttccttgattatttgtttaaataggttaactggctggagctagatacgagaatttattattactttcgtccctggaatatttttttaactaattcaaatcgtttgagaaagttggttattttagttaataacattaaatgttaacaatttgtattattttttcaaaattattttt

SEQ ID NO: 242 - DNA, 627 bp, Glycine max
  misc_feature (619)..(619): n is a, c, g, or t
acgaggcctgggccaacccccacacgcttcagtctctctgtttccgcggcggaaaccaccgcttttgccgcccctcccactccccaacctgaggtgcttctcttctctcacttttccaccctccttttctctttctttcaatttctctcacttaattgctgtgattattagaagcttggagttgtagttaagccaacggagaagccgagacttgtgttgaagttcatatggatggagaagaacattggaattgcgcttgaccagatggtaccgggccatggcaccatttcttctgagcccatattacttttggccccgaaaagatgcctgggaagagctcaaggagttgcttgagaacaagccttggatctctcagaagcagatgattattcttctcaatcaggccactgatatcatcaatttgtggcaacagagtggtggcaacttatcctgaactcattcatgtgccaacatatttcaatgatgtttttccttttcatgttatgtttttctcttgtactgcattttcggctgtgctcttcctctttctatgtatgcctggcatgtgcttgattattattactatcaactaatccataaattctttctcgtgattcanaaaaaaaa

SEQ ID NO: 243 - DNA, 2414 bp, Glycine max
tcagctacgtaggcccccccccgatcgaattcataatatcattttgcgtgttatcaactgaactaatattactgtatacacaatttgcatgcctaacaacaaaaaaagaaaaagagaaacctaatagagcggagagttgaagagcaagagctagggaaagggacaaacagcccttcggagatctcaagggcctttccctcgttctctccgaactctcactttgtcttcttatttgctccttttcttctctcttccctccccaattattcattccctcatggccaccacgctttattcaacgccttgtcgttcactggctacttcatcctcctcttcctcgtcgttgcaaccctgccctctgtcgtctaacctcgcttaccctcaacgcgtcaacttctcacagcgctttctcgcctccaaggtctctctcaaatctcaaccccaaccgtatcagattcccgttcacacccagcagccggaaggtacagtgacagctgctgtgacccctgttgaaaatggcacttctcacaagcagttgaaggctgacttattgtctcttaagtccccagatgagtctgaagacggttttgaaaaggatgaaaatgagtccagtgttagtattactgttgttggagcctctggagaccttgctaagaagaagatatttccggctctctttgcgctttactatgaggattgtctccctaagcacttcaccatctatggttatgcacgaagtaagatgactgatgcagaactgagaaatatggttagcaagaccctcacttgtagaattgataagagagagaactgcaatgagaagatggaccaatttctaaaaagatgtttctaccattctggtcaatatgattctcaggaaaactttgcagcactagacaagaagctgaaggaacatgagggtgggagaacttctaatcgcctgttttatctttcaattcctcctaatatattcatagatgctgttaaatgtgcaagcttgtcagcttcttctggtaatggttggaccagggttattgttgaaaagccttttggccgtgattcagaatcttcggctgcattaacaaaatcactcaagcagtatctgacagaggatcaaattttcaggattgaccactatcttgggaaagagcttgtggaaaatctttctgttctccgattctcaaatctcatctttgaaccattatggtcaaggcagtatataagaaatgtacagttgatattctcagaagattttggcactgaaggacgtggcggaatttcaattacctgatggatgtcaggtcaaggttcttcgttcgatgagacccctacgacttgaggatgtggttataggtcagtataagagccacactagaggaggagttacatatccagcatacgttgatgataaaactgtaccaagcggcagcttaactccaacatttgctgcagctgccctcttcatagataatgcaagatgggatggggtaccttttctgatgaaggctgggaaagcattacacaacaaaagagctgagatacgggtacagttcaggcatgtgccaggtaatctgtacaatcggaatttcggtactgatcttgatcgggctacaaatgaacttgttataagagttcagcctgatgaggctatttatctgaagataaacaacaaagttccgggtctgggaatgaagttggatcgcagtaatctcaatcttcactacgctgcaagatattcaaaggagattccagatgcatatgaaaggttacttctggatgccattgaaggagaaagaagactcttcattcgtagtgatgaactggatgctgcttggtcactctttacacctgtactgaaggagcttgaagagaagaagataattccagagtactatccttatggtagtaggggtcctgttggtgctcactatcttgcagccagacacaacgtgcgatggggtgaccttgggacagacgtagaccattaaccctcgcattttgttgcacttctgatcggcctaagatgttagctattatgcatgctattttgtggtttcttcttggcatgcagtttcttttctcatcagcagcatggttacttctctggtggaagacaggtaccaggcacacacgaaaatcatacaaagcaataaaagcatcaaatttcaaagtccagtaataaagctcttagatcattgattttttttttttagtttttgttgctatttgggacagtttggacaagagcaaatatttcatttagttgccaatcgatctagttaggtgatgtattttgattttgcattttgcattttgtgaaacacaattaaagagaaaatgaagaaagttagcaagttggtatgaatctcaacccattcaaaaaaaaaaaaaaaaaaaaaaaaaaaaaaaaaaaa

SEQ ID NO: 244 - DNA, 2177 bp, Glycine max
tacggctgcgagaagacgacagaagggggacacacatgggcaaaaaagaagtgtccaggttcatcctcctgaaccagtctctgtcgaagaaggaaggccctttatatataaaaacctaaactcgtattgttctgagcaacccaggttgtctgttacggattagcatcaaagcaagttaacaaaatttgggtgcgtcctggattgacccttttgccccctctccctcaccctccactaactcctcctttttggtttttataaagcacattcccaatagaggagggtccctacacaacacaacccttcaatgacgtccatggccactttcttcgcccaaacctccttcccctcccactctctctccaaaaccttcgatacccatttcgcccctgccccgaaagtcaacgtctttgtgaacttcagggcgaggaggcacgttggggtgcgagtttcgaacgcgctgatcgaaccagatggagggaagctcgtggagcttgtggtgacggattttgagagggatttgaagaagggtgaggctctttcgttgccgaggatcaagctctcaaggattgaccttgagtgggtccatgtcctcagcgaaggatgggccacacccctgaaaggcttcatgagagaagccgagttcctccaaacgcttcatttcaactcgctccgactcgatgatgggtcggtcgtgaacatgtcagtgcccatcgtgctggctattgatgatgcgcagaagcatcggatcggggataacaaaaaggttgctctttttgattccaagggagaccccgttgcaattctcaataatattgagatttataagcatcctaaagaagaaagaatagcccgaacttggggaaccattgcccctggcctaccttatgttgaacaaactataaccaatgctggaaattggttgattgggggtgacctagaggtcattgaaccaattcagtacaatgatggacttgatcattttcgtctatctccgacacaactccgtgcagagttcacaaggcgcaatgcggatgctgtgtttgccttccagctccggaatcctgttcacaatggccatgctttgctaatgactgacacccgaaagcgccttcttgagatgggctataagaatcctgtcctcttgcttcatccacttggaggctacaccaaagctgatgatgtcccacttgattggcgaatgaagcaacatgagaaggtacttgaggatggtgttcttgatccagagacaactgtggtatccatattcccatctcccatgcactatgctggacccacgggaggtgcagtggcatgcaaaggctaggatcaatgcaggggctaacttctatatcgttggtcgtgaccccgccaggcatgagccatccagttgagaaaagagatctgtatgatgctgaccatggaaagaaagtattgagcatggcaccgggactagagcgtctaaacattcttcctttcagggttgctgcatatgacaagactcagggtaaaatggcattctttgacccttcaaggcctcaggacttcctgttcatatcaggcacaaagatgcgcacactggcaaggaacaaagaaagtcctcctgatggatttatgtgccctggtggatggaaggtgctggttgattactatgatagcttagtactctcaagcaacggcaaagtgcaggaagctgttccagcttaatcttgtatcatatcataatgtatatatctcatgattgggagaaaccttaagcttatgtattctcctgctaagacatacttcacgaggatcctctggcccaatctaataataataataaattaaaactttggggaggcacaagcacggacacattgcctctctctgtatgtatggcatttagacagcctcttgcacttatggtgcaattgtgcatgccaactctctgtaatataatgaatgtggttgtgctaaggatttggtttgatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccccccattttggaacctcccccccccggaatttatttcggaccggggcccggggggggcccaatttttcctttaaggg

SEQ ID NO: 245 - DNA, 495 bp, Glycine max
cgccacgtaagctcggaattcggctcgagctcgagccgattcggctcgagtccatggccactttcttcacccaaacctccttcccctcccactctctctccaaaaccttcgatacccatttcgccccatccccgaaagtcaacgtatttgcgaacttcccggcgaggaggcacgtgggggttcgagtttcgaacgcgctgatcgaaccagacggagggaagctggtggagcttgtggtgagggataattcagaaagagacttgaagaagggtgaggctctttcgttgccgaggatcaagctttcaaggattgacctggagtgggtccatgtcctcagcgaaggatgggccacacccctcagaggcttcatgagagaagccgagttcctccaaacgcttcatttcaactctctcagactcgatgatcggcggtcggcaacatgttattgcccatcgtgctgcctttttatgatgcccaaaagcataagatcgggga

SEQ ID NO: 246 - DNA, 2177 bp, Glycine max
ggctcgagcgaaacattgcttgcaaaaacaattcacgatcacagactttgagcgaccttgttcatggcaagttttctgctagaaaagaaaaagactagttagttaggcttttatgcaaagaacagagttctcccaaacacttcaatcaaacatggctttaccagccaatgaaacctccatggcagaaaggtctcagtgggtgctcaatgctcctgctcccccatccacgtggcacaacctcatggcttctgtgaggaacacaatttcatcgtaccaaaaaatgtgggcttaaataagaggccaacctggacccaaagttgtgctttccttcttgcggagcatttttcctattcttcattggggtcgtaattattcaccaaccaaattcagaaacgacttacttgcaggtcttaccattgcaagtctctgcattcctcagagcattgggtatgccactttagcaaagcttgatcctgaatatggactctatacgagtgtggtgccacctcttatctatgctttaatgggaacttcaagagaaatagcaattggacccgtggccgtggtatcgcttcttttgtcatcaatgattcagaaattaatagaccctgccattgatccaaatgggtatagaaagcttgttttcactaccactttctttgctggcatatttcaagctgcttttggactcttcaggttggggttccttgtggattttctgtctcatgctgctattggtggattcatggggggagcagctataataattggtctacaacagctgaagggactatttgggatcaatcattttaccaaccaaacagacattaactttggcatggaaatcggtttgggaatcggttgatcatccctggaatcctcgcaattttgtccttggatgttcattcttcattttcatcctgtttaccagatttctgggtaaaaggaataagaaacttttctggctgccagcaatatcccctcttgtgtcagttatgctatcaactcttattgtttttctgacaagagccgacaaaagtggagttaatattgtgagacatataaaaggaggattgaacccaagctctatcaatcagatagacttgaacagcccccatattggagcattggccaaaattggactagttgttgctgctgttgcactcactgaatcagttgctgttggccgatcttttgcatccatgaaaggataccatctagatggaaacaaggagatggtgtcattagggttcatgaacatcataggatgcttcacctcatgctatgttgcaactggttcgttctcccgcacggtggttaatttcacagcgggttgtgaaacattagcgtcgaacattgtgatggccattgtggtcttgatatcactacaatgtttgacaaagctattgtactttaccccaactgctattctcgcttcaataatcctttctgctctcccgggactcattgacatcaatgaagcttacaaaatatggaaagttgataagcttgattttcttgcttgtgttggagccttcttcggggtgctctttgcgtcagtggaacttggtctgctagtggctgggtcctatccacgctctcctgttgggccgcacttcaacagaaagccccactctctagcaactttaacttacgtgcttttgattaggtctaatagtgttgatcaggtgggtatatcttttacaaagataatatggatctcaattggagcaggcacagaaactctgggaagacttcccggcacagatgtgttctgcgatgcacaacagtatcctatggctgttaagattcctggggttgcaataatacgcgtcaagtcttcattgctttgcttttctaatgcaaattcagtcagagaaaggatcctgaaatggatatcccgggaagaagccaagggaaacatagaagacaacaccggaagcataattcagctcgtaatccttgacacctctaatttggtgagcattgacacctcaggaattgcttctcttgaggaactgcacaagagtttggtctcaagtgggaagcatctagcaattgccaatcctcgttggcaagtgatttataagctaaaggcgaccaactttgtcacaagaattggaggaagggtcttcttgactattggagaagctattgactgcaagctggatttctga

SEQ ID NO: 247 - DNA, 2346 bp, Glycine max
cggacgcgtggacaggtaagtcacatcacatgagagtgtagttggtcagtttttcacgagacaaagttctcccaaacacttcaacatggcttcttcagctatggaaacctgcaaatcagaggatttgcacatgcaggttgacattgagaagaacgcgaaggacataaggtctcagtgggtgcttaacgctcctgagcccccaagtccatggcgtgtggttgcagattctgtgagcaaaactatctcccactataaacataaactttcctctctcatagatcaaccctgcaccacactcctcctttcagttctgcaggtggtttttccaattcttgcttggggcagaaactacactgctactaagttcaggaaagatcttcttgcaggtctcactattgctagtctttgtattccccagagcattgggtatgccaccttggcacatcttgatcctcaatatggcctttatacaagtgtggtaccaccacttatctatgctgtaatgggaacctcgagggagatagcaattggtccagtggcagtggtttctcttctgttatcctcaatgatggagaaattagtagaccctgctactgatccagtgggttatacaaagctgattttgcttgctactctctttgctggtatctttcagacttccttcggactcctcaggcttggtttccttgtggatttcctatcccatgctgcaatagttggatttgtggcaggagcagccattgtgattgggcttcaacagttaaagggactcttaggaattacccattttacgaccaagaccgacatagtctctgtcatgaaagctgtttgggaagcagttcataatccatggaaccctcgaaattttatcctgggatgctcgttcttggtcttcatcctaacgacgagatgtttgggtaaaaggaagaagaaactattctggttggcatcaatctctcctcttgtatctgttgttgtgtcaactctaattgtgtttatcacaagagctgataaaaatggagttaaaattgtgaaacatgtcaaaggggggttgaatccaagctccatccatcagttagacttcaacaacccctacattggagaagtggccaaaattggactagtggttgctgtcgttgcccttactgaatctattgctgttgggcgatcgtttgcatccatcaaaggataccaacttgatggaaacaaggagatgatgtcaataggtttgacaaacatcataggatctttcacctcctgctacgttgcaactggttcattctcccgtactgctgttaattatgcggctgggtgtgaaactttggtgtcaaacattgtgatggccatcacggtgttgatatcactgcagtttttgacaaagctattgtattacactccaacagctattcttgcttctgtgattctctctgccctaccaggactcattgacctcagtgaagcttacaaaatttggaaggttgataagatagactttcttgcatgcgctggagcattctttggagtactgtttgcttctgtggagattggtctacttgttgcggtggtaatatctttttcaaagatcattctcatttcaattcgaccagggacagaaactctaggaaaacttccgggaactgatttgttctgcgatgtctatcagtatcctatggcagttaaggttcccggggttatgataatacgagtcaagtctgcgttgctttgctttgcaaatgccaatttcgttagagaaaggatcattaaatgggtcactgaggaagaatcagaagatgacaagggaaattcaagaagcaccattcaatttctaattcttgacacctccaatttggtgaacattgacaccgctggaatcactgctctagaggaactgcataaaagtttgtcttcacatggaaaacagttagccattgcgaaccctaggtggcaagtgatacacaagctaaaggtgtccaactttgtcggcaaaatccgaggcagagtctttctgactgttgaagaagctgttggctgcaagagccgctgctaagttggataaccacacctgagtcttatgatgtatctcatgtgggaaaacaaaaaacagtgtctaatatccatttgtctttgtggaaaatcataacactagtgcttgtgaattgttcccttgtatttccactcccaagtacgtacgttatgtacgaaatgggacatcagaataagtcatctcgtaattcatgttagagatgctgtgagtttctcttatgttcatgtatgtgcttaataaaatagcaatttgaagtgacgtgtttgttaataaaaaaaaaaaactcgagccgaatttcgagc

SEQ ID NO: 248 - DNA, 957 bp, Glycine max
atgaataagagtgggggaggagagatgagtaagtggccgttcacaatgtctcagtggcaggaactggaacatcaagctttgatttacaaatacatggtggctggtcttcctgtccctcctgatctagtccttcccattcagaacagcttccactccatttcccaaaccttcttgcaccatccctctaccaccatgagttattgttccttctatgggaagaaggtggacccggagccaggacgatgcaggaggactgatgggaaaaagtggaggtgctccaaggaagcctacccagactccaagtactgtgagcgacacatgcaccgtggccgcaaccgttcaagaaagcctgtggaatcacaaactatgactcagtcatcatctaatgtgtcatcattgactgtaactgctggcagcagcagcagtgcaactggaaatttccataaccttaccaccacaaatgcatatggtaatccccaagggactggttctggatcagaccaaacccactatcacatggattccattccctatgggatcccaagtaaagaatacaggtattttcaaggacctaaatctgagggaggtgaacatagtttcttgtccaaaactttaggaagcaacaaggttcttcacatggagtcacagatggataacactttgatgccaaccagtggagttgcctcattctctacattgagatcaaataataattccatgttgcagggtgattatctgcagccttctttcttatctagtgagtatgcctcagcagaaactgtgaagcaagagggtcagttccttcgacctttctttgatgaatggcctaaaaggagggactcatggtctggtctggaagatgagggatccaaccacactcaactctcaatatccattcctatgtcagcatcaaatttctctacaactagctctcattccccacatggtgagatttaa

SEQ ID NO: 249 - DNA, 1309 bp, Glycine max
acctaaactaaactaaacaaaagaataataaaaaggagaagatgatttagaattggtttgagaagagaagaggatgaataagagtgggggaggagagatgagtaagtggccgttcacaatgtctcagtggcaggaactggaacatcaagctttgatttacaaatacatggtggctggtcttcctgtccctcctgatctagtccttcccattcagaacagcttccactccatttcccaaaccttcttgcaccatccctctaccaccatgagttattgttccttctatgggaagaaggtggacccggagccaggacgatgcaggaggactgatgggaaaaagtggaggtgctccaaggaagcctacccagactccaagtactgtgagcgacacatgcaccgtggccgcaaccgttcaagaaagcctgtggaatcacaaactatgacacagtcatcatccaatgtgtcatcattgactgtaactgctggcagcagcaccagtgcaactggaaatttccataaccttaccaccacaaatgcatatggtaatccccaagggactggttctggatcagaccaaacccactatcacatggattccattccctatgggatcccaagtaaagaatacaggtattttcaaggatctaaatctgagggaggtgaacatagtttcttgtccaaaactttaggaagcaacagggttcttcacatggagtcacagatggataacactttgatgccaaccagtggagttgcctcattctctacattgagatcaaataataattccatgttgcagggtgattatctgcagccttctttcttatctagtgagtatgcctcagcagaaactgtgaagcaagagggtcagttccttcgacctttctttgatgaatggcctaaaaggagggactcatggtctggtctggaagatgagggatccaaccacactcaactctcaatatccattcctatgtcagcatcaaatttctctacaactagctctcattccccacatggtgagatttaaattaggccatgttgaatgaaaccacctgaatcctgtaattatattgctgcagacaactaagaaccgcccctttgggttctgaaaggaccaaagagcccctttagtttcgactctagctcccgtgttttgtgcactttctgttgagcaagttgtctaccactgtggaacttcatctggtgggtggattttaatagaatccatcaactttcttgttttccgtctaatgaacaaactacagtattttgtcctgatttaatggatgcaaaaaaaaaaaaaaaa

SEQ ID NO: 250 - DNA, 1495 bp, Glycine max
acgacagaaggggtcagctacgtaggcccccccccccaaaagcaaacccaaatccaaatggttccttccgacaaagctcgatccgagtgtgatctcatgtttcggctctaactatgtttgatttcgatacccaacaagagtgtcgtgttattaataggactaagagtagcgcaagtagacaacagtggaaaacatgaacatcagtggcggaggaggaactgtgatgggtttgagtaatgggtattgtgggaggtcgccattcacagtgtctcagtggcaggaactggagcaccaagctttgatcttcaagtacatgcttgcgggtcttcctgttcctctcgatctcgtgttccccattcagaacagcttccactctactatctcgctctcgcacgctttctttcaccatcccacgttgagttactgttccttctatgggaagaaggtggaccctgagccaggacgatgcaggaggactgatggaaaaaagtggaggtgctccaaggaagcatacccagactccaagtactgcgagcaccacatgcaccgtggccgcaaccgttcaagaaagcctgtggaatcacaaactatgactcactcatcttcaactgtcacatcactcactgtcactgggggtagtggtgccagcaaaggaactgtaaatttccaaaacctttctacaaatacctttggtaatctccagggtaccgattctggaactgaccacaccaattatcatctagattccattccctatgcgattccaagtaaagaatacaggtgtcttcaaggacttaaatctgagggtggtgaacactgcttcttttctgaagcttctggaagcaacaaggttctccaaatggagtcacagctggaaaacacatggccttcgatgtcaaccagagttgcctctttttctacatcaaaatcaagtactgattccctgttgcatagtgattatccccaacattcgtttttatctggtgaatatgcatcgggagaacacgtgaaggaggagggccagcctcttcgacctttttctaatgaatggcctaaaagcagggagtcatggtctggtctggaagatgatatatccaaccaaacagccttctccacaactcaactctcaatatccattcctatgtcttccgatttctctgcaacgagctctcagtccccacatgataattagagcagtccttcaagattttcagtgcaatgttatggaaggatcaaataagtctagtagtagatgtgtggtccaaaggaaatcccatgttcaagtatcttcattcaagctgagctgttgtacaactttatggaacctcagccatttgttataagcaagaccataatcttcttatttgatggtgggtatttgttgaaccttggaacattcttggttttgtatctaatgaaaacataaatacttcgtactgaatgagtttatgctgaataaagtcactagttttgttcgaaaaaaaaaaaaaaaaaa

SEQ ID NO: 251 - DNA, 2055 bp, Glycine max
gaaaacaagaagcaataacactcaaaaactcctctcttttcctctcctcacatttctccctgaacctctccccacattactgcactgtgaggtgtctgaaatagaatagcttcttctgtttcatttgttactatatcacccaccagcaccagcctttgtgctagctctttgattcctttttactcttttttcgttttttttttcctgttctttccctttcccctctgctcgatgatgaatggaaggaacgttgacacaaacaggttccccttcactccttcccagtggcaagagcttgaacaccaagccctcatctacaaatacatggcttcaggtatttccatcccccctgaccttctcttcaccatcaaaagaacaacccacttggactcctcaagactcttgcctcaacactttgggtggaattatttgccaatgggattggggagaaaaatagacccagagccagggaggtgtagaagaacagatgggaaaaaatggaggtgctcaaaggaggcgtatccagattcaaagtactgtgagaggcacatgcacagagggaaaaaccgttcaagaaagcctgtggaagttttgaaaacaacaccaatgacagcagcagtggcaacaaacacagatgcctcaaccccaacaacaatcttatcaatcaccaaaaacagtcctgtactcttcccaaccactcattctctgtctcatgacacttaccatcatcatcaccatcatcactctcaccctcagcaacattcctcccactccttcctctatcattcttcgaggccctcttccggtggtgtttctttgtcatttcaagacaacagtgcccccttgtttctcgacactgcttcatgctctcagaataacaacaacactgactgcaggtatgtgtatggactaaaagaggaggtggatgagcatgcctttttcacagaaccttctggaactatgagaagcttctctgcttcctcaatggaagattcatggcaactcacaccactgactataagctcctcttcctcttcaaaacagaggagttgctctggtttatccaatgacagcaatgagtactcctacttgcaacttcagagcctcagtggcaacaactcaaagcatccacagcaagatcaaagttgctacatatcaggcagtgatatcaagtgcgaaacattcatgaaacttgggaaagaagaacctcagaaaaccgttcatcgcttcttcgatgaatggcctcccaaaagcagaggatcatggcttgatttggatgataaatcatccacaacccagctttcaatttccattcccacttctactcatgattttgcaactttcagttcaacaacccaacgagatggttgagtttagctttcaatagtggggtccttcagtccttgtacttgaatcaaaggccaataatgtacttacatggtggggttcacattatgttgtgatttgtgagatctctctttaattgctccccctttttccatctgttttctaagtgttgttgaagctgatttgtgtttccatggagggatccaatgtgtttgtgtgctagtatttgctttcaatgttgtgttctttctactctctcattttgtgttctttgtggtttgagctaacactcaaagacacgtccttttttgcttgttcatcattctcagctgagtacaatattattattttggaaaaaaaaaaagaaaaaaaaaaaaaaaaaagcttatcgataccgtcgaccccagaggggggggcccggtaccccattcgcccctatagatgaagtcgtattacggcgcggctcacctggcccgtccgttttacaaacgtccgtgactggggaaaaaccctggcggttaccccaaacttaaatcgcccttggcagcaaaattcccccttttcccccaacctggggataaataagcccaaaaaggcccccaccaccgaatcggaccccttctccaaacaagttgggcccagccctgaaaagggggcgaaatgggaaaaattggaaaagccgtttaaaaaattttgggtttaaaaaaa

SEQ ID NO: 252 - DNA, 427 bp, Glycine max
  misc_feature (300)..(300): n is a, c, g, or t
agattggcatggaacacaagatggaaagtcgtgttgttgatgagaggaagagggttgttatggtcaaggaagagaacagcacttcttctcccaacagtgttgaacttcatctcgggtttgatgcttctcattcgactccacaagaaataaaccatgtgatcactgaagctcagaggcgtgagcttcaccatcaagttttcatcttcaaccatttggcttataatcttcctcctccttatcaccttgtgcaattccctagcaacatgtcagaacctcataggtgtagaagaactgatgganagaaatggaggtgtggtaagaatgtggtgcctaaccagaagtactgtgaaaggcacatgcacagaggtcgaaatcgttcaagaaagcctgtggaaacatctcaagttaactctcctttggcacaaag

SEQ ID NO: 253 - DNA, 1528 bp, Glycine max
tcgagtcagctacgtaggcccccccccccctattttcctcttctacttctctacttactttgatgatgaatggaaggaacaggttcccctttaccccatcacagtggcaagagcttgaacaccaagctctcatctacaagtacatggcttcaggcatttccattccacctgatcttctcttcaccataaaaaggagctattttgattcccctctgtcctcaaggcttttgcctaaccagccacagcactttggatggaactaccttcagatgggtttgggaagaaaaatagaccctgagccaggtaggtgtagaagaactgatggcaagaaatggagatgctccaaagaagcatacccagattcaaagtactgtgagaggcacatgcacagagggaagaatcgttcaagaaagcctgtggaagttttgaaaacaacaacaccatcatcaacaatgacaacaacaaacacaaactcaaatgcttcttcaacacaacaagcaatctcatcaatcaccaaaattaatagcactctctcacctcttgcatcatctgagactcaccaacaccaccactatcctcaacactatggctcctttctctatcatcatcaccctccttcaaggtcctctggcattggcttgtcttttgaagacaacagtgctcccttgtttcttgacactggctcatgctctcagtccaacacagactgcaggagtaggtatgtttatggagagaaagaggaggtggatgagcatgctttcttcacagaaccttgtggtgttatgaaaagcttctctgcttcctctatggatgactcatggcaactcacaccattgactatgagctcctcatcttcatcttccaagcagaggagttcctttggcttgtccagtgattactcttgcttgcaacttcagagccactcaaagcagcagcagcaagagcatcatcaagatcagggttgctacatgtttggtgctggtcaagttgtgaaagaagaacctcagaaaacggttcatcgcttctttgatgaatggccacacaaaggaagagaaggctcttggcttgatttggatgacaaatcttccacaacccaactttcaatttccatccccacatcttctcatgatttttcaactttcagttccagaacccaccatgatggttgagtgtaggtttccaataatgggtcctctgtacggaaatcaaaggccaaaaatgtacctataagggtggggtttaagatgctttggggtcttatttccaaccacaccctcttcttttttcttctgccataaaggcacttgaaagggatttctgtctccatggagagatctaatgtgtaatgctatatgatgctaatgctttcttagttataagtgcttccttccaaacatagtataaaaaattctctgtgacaaagcctgaactgtttaatatttttgagctaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 254 - DNA, 1872 bp, Glycine max
atccccttttaacagttttttattattcacacggaaaaaaagtaagaaaagaagcttttttcccccttgatcatcactatcagatacagaccctctagagaaaaaggaaaaaaaagccttcatgtgaatgtgacaatggaagctaagcctcttcgaactgttccctcttcacacaacacttctggggtaggaggtggaccccagaagaagattgacatgggacacaagatggtaggtgatgttggtggtcttgttgttgattaaagaaaggggaaaaaaagccttatgtgaatgtgacaatggaagctaagcctcttcgaactgttccctcttcacacaacacttctggaggtggaccccagaagaagattggcatggaacacaagatggaaagtcgtgttgttgatgagaggaagagggttgttatggtcaaggaagagaacagcacttcttctcccaacagtgttgaacttcatctcgggtttgatgcttctcattcgactccacaagaaataaaccatgtgatcactgaagctcagaggcgtgagcttcaccatcaagttttcatcttcaaccatttggcttataatcttcctcctccttatcaccttgtgcaattccctagcaacatgtcagaatacagtttcctgggttttgatcatgggattatggtggatccagaacctcataggtgtagaagaactgatggaaagaaatggaggtgtggtaagaatgtggtgcctaaccagaagtactgtgaaaggcacatgcacagaggtcgaaatcgttcaagaaagcctgtggaaacatctcaagttaactctcctttggcaacaaagccttgtagcaagtcacacaccaaaccatcctcaaagacacaatttgaaatttcaagtccaaaccttatcgccattccacatattgacacatcaagtaccccatcaaggagcctcagtgtcaccaattgctcttctgctaataataggtcgaaaaatagggcaggttatgctgactacctcatgtcgttttcttccgcgtccacagtgtcccctggaaccactcttgccactccagttgcccctaagatagctgccttcagcagtgcgacatccgttgttgcttcagatagcaaaagttgcctaaagatatgccagaaagataaccagtccaagagctgtatcagcaacaacatcggtgttaaaagcggtgggaaaggaagcattgttggtgatactaatactaatggcatctctactggaataagcttctccccaacgagtgttcttcaagtttcagtttctggttgcaacccttcatacctgaatgacggaaccaacatagaagctgcatccggtaggtgccggagaacagatggtaagaagtggcagtgcaagagtgctgttcttcctggtcagaaatactgtgccacacacatgcatagaggtgccaaaaagcgtctcacaagccatgaaccagcagctactgctaccagttccgccgttaccgttgcgcggttgccttactcttcagccactaccaacatacagaaagcgcattgtgcaattccaaacacaaatctttccatgtcagtccaagccagggaagcattcatacaatgtaatgagaaaagtcaaagtagcagtgacactgatactactatcagtgacaccttgaatgagtatagctatgcttctttctgagaagctcttttgttttttgttttttgaaacttgcatcatgtttacacgaacaaaagtaaacaagtaacttgtaacatttgaggtcagttatgtgtggactgaacaatgatctccatgaagaaaagattaaccacgtgtttgttgtttttaatcgaaaaaaaaaaaaaaaaag

SEQ ID NO: 255 - DNA, 1647 bp, Glycine max
atccctaccattgagatatttttatctatcaaacaaaacaatcatgtcttaactcctcctccttctgcttctctccgaggtaaccgcccccacttttttctaatgcagaatatttccctctctctctttccctctttatcttcctctttcagattcaccctcgttttccctctttcgcataaataaataaataaatataaacaccatgagcgttcctccgccgtctacggcggcgatgtggacgccgttcacggcagcgcagtggcacgagctggagcaccaggccctcatcttcaagtacctcaaggcgggtctctcggttccccctgacctccttctccccattcgcaagagcctccaattgatatcgtctcacccatcgatggggtattatgggaagaagatagaccctgaaccgggtcggtgcaggagaaccgatgggaaaaagtggaggtgttcgagggatgcacaccctgactccaagtactgcgaccgccatatgatacgacgtcgttaccgttcaagaaagcctgtggaatcatctcaaactcactcttcttcttctgcttctgctgcttcttcaaattcaaaccctgttgctgctgctggtggtggtggttctgttgctaatgtttctgcaactgctgcaaaaaaccttcacacacttcccttgcacatcaatggcgcaagggaaggtttcactttcacccttgggaacaacaccagcaccaacaccaacaccaacaccaacaccctccctcaccttcacatgaaccccctcactctttcagctgacaataccaagaaaacttacaggtttggactgaactcagaagcagatgagcacaacgtcttacagaaagatctgggaagtgtgaggtatcaaggttatgactttacctcagatgccatgtggtctcaaatgtctcacattccatcaaatactgtttcggaatcaagaatcggttctactatgctgggcaactgcttccagcatcaaacaatgcgagatgctgagctgttgaatctggaaacggcgaggaccaaagaccttgtctttagtggccagctaagttctgcagggggtatgaaacaggaatatcagtctccccagtctctcttcagtgactgggactggaagaaggatttaagttcctctgcccttgagtataggcccaacaaggattttaactgcaacccagatgtcaatgttgattaaaatgcttctttataaggcttggaaagagtgtttttgtttcgtgtcgtgatatgtcagcatccatccgaagtccattttaatcaggaactggttccctacccttttgttttttcccaaaccaatgaaaatacaagtcctcaggcagtgatgatttttcatccatagctttcagagacccgagggagtcatggtttaatttcgtgttgttcttttatataaacttaaaatacttgaaggagttatgctttctttaaatgtaaacctgtaatagtatttgactgtttttgttgttcttcgttgtaatgtcatgtaatttgactcttgtctcctatggttgtagtcccttgattgttagacagattgtgctattttcaggcagcaagcaaggtcacaagtatgtttaattattgtatgaatgattgtgattg

SEQ ID NO: 256 - DNA, 862 bp, Glycine max
  misc_feature (753)..(753): n is a, c, g, or t
  misc_feature (771)..(771): n is a, c, g, or t
  misc_feature (805)..(805): n is a, c, g, or t
ggctcgagcacattttgcatctttcaatagaagtaaatggaggcagcagcagaagcacttccgtgccgagcttaccctttctgaatccccttttaacagttttttattattcacacggaaaaaaagtaagaaaagaagcttttttcccccttgatcatcactatcagatacagaccctctagagaaaaaggaaaaaaaagccttcatgtgaatgtgacaatggaagctaagcctcttcgaactgttccctcttcacacaacacttctggggtaggaggtggaccccagaagaagattgacatgggacacaagatggtaggtgatgttggtgttgttgttgttgatgaaagaaagagggttgttgtggtcaaggaagagaaagagaacacttcttcctacagtgttgaacttcatctcggggttgatgcttctcattctgctccacaagaaataaaccatgtgatcactgaagctcagaggcgtgagcttcaccatcaagttttcatcttcaaccatttggcatataatcttcctcctccttatcaccttgtgcaattcccgagcaacatgtcagaatacagtttcctgggttttgatcatgggagtatggtggatccagagcctcataggtgtagaagaactgatggaaagaaatggaggtgtggtaagaatgtggtgcctaaccagaagtactgtgaaagacacatgcatagaggtcgaaatcgttcaagaaagcctgtggaaacatctcanattaactctcatctggcnacaagccatctagcaagtcacacaacaaacccgnctcaaggacacattttgaaattttaaatccaaaccttatggccattcgacatagtga

SEQ ID NO: 257 - DNA, 379 bp, Glycine max
  misc_feature (17)..(17): n is a, c, g, or t
gtctaatgtagacccanaaccaatcataaaccatgccttgcagacacgatggggacccactgtcgcaaatgcctacaccataaatggacttgccagccctttgcattattgcgcttctgaagcatacatacacagtcaaagtgatagccaggccagacatatcttgctaatactaattaatgctgcactcaacgaagagcttctcttcacattagaccacctcacccttactgaggttgaagcacatgccatattcaccaacccatttgacacatacacactgctactagcccctggccaaaccacaaacgcagcttctgaaaaccaagccatataatgccgaagccacatttcatatgtctgctacgccttatttcac

SEQ ID NO: 258 - DNA, 524 bp, Glycine max
  misc_feature (448)..(448): n is a, c, g, or t
atggacttccagggccattgtataactgttctgctaaagatacattcaagctaaaggtcaagccaggcaaaacataccttctccgtttgatcaacgctgcacttaatgacgaactcttcttcagcattgcaaatcacactctcacagtggttgatgtagatgcaatttatgttaagccatttgacactgacactattctcatttcccctggacaaacctccaatgttcttctcaaaaccaaatctcactatcctaatgccacattcttgatgagtgctagaccatatgcgactggccagggcacttttgacaactcaactgtggctgctatccttgaatatgaagtttcaccacacgctcttcactcaacaacttcaatcaagaagctttcactcttcaagcccattctccctgcccttaatgacacttctttcgcgacaaacttttncaacaagcttcgtacctttacaagggcttagtttcagccaatgtaccccagaatttgataagcctttttcttcaca

SEQ ID NO: 259 - DNA, 1814 bp, Glycine max
cttcagcattcacactaaggtgttccttgctcgccaaaagatcatggagcctgccaaaaccattcacaacaatgtcaaatactcccccatcttcttagccatctttgttctgatcttagcttcagcattgtcttcagcaaatgccaaaattcacgagcacgagtttgttgttgaagcaactccagtgaagaggctgtgcaaaacccacaacagcatcaccgtgaatggacaatacccgggcccaacgttggaaatcaacaatggagacactttggtcgtcaaagtcactaacaaagctcgttacaatgtgaccattcattggcacggtgttaggcaaatgagaacagggtgggcagatggaccagaatttgtgacttcagtgcccgattcgtccaggaggaagttacacctaccgttttaccgttcaaggacaagaaggcacactttggtggcacgctcatagctcatggttaagggccaccgtttacggtgctttaatcattcgtcctagggaaggagaaccctaccctttccccaagcctaagcgcgagacacccattcttcttggggaatggtgggacgcaaaccctattgatgttgtgaggcaggccacacgaactgggggagccccaaacgtgtctgatgcatacactatcaatggtcaacctggtgatctttacaagtgctccagcaaagacaccaccattgtcccaatacatgccggcgagaccaaccttcttcgtgtcatcaatgctgcactcaatcaacctctcttcttcaccgtcgcaaaccacaaactcacagtggttggtgccgacgcctcctacctcaaacccttcaccaccaaagtcctcatactgggccccgggcaaaccaccgacgtcttaatcaccggcgaccagccaccttcccgctactacatggcggcgcgtgcgtaccaatccgcccaaaacgctgccttcgacaacaccactacaaccgccatactcgaatacaaatcaccgaatcaccacaataagcattctcaccatcgtgccaaaggagtaaagaacaaaaccaaacctataatgcctccactccctgcttacaacgacacaaacgcagtcacttccttcagcaaaagcttcagaagccctagaaaagttgaagtacccactgaaattgaccagagcctcttcttcactgtgggtttaggtatcaagaagtgccccaaaaacttcggaccaaagaggtgtcagggacccattaatgggacgaggttcactgcgagcatgaacaacgtgtctttcgttctcccgaacaacgtgtccatcttgcaggctcaccacctcggaatccctggagtgttcaccactgattttccggggaagccgccggtgaagtttgattacaccggcaatgtgagccgttcgctgtggcaacctgttcccgggacaaaggcacacaagttggagtttgggtcgagggtgcagattgtgttgcaggatactagcattgtcactcctgagaaccaccctatccatcttcatgggtacgatttctacattgttgcagagggtttcgggaacttcgacccaaagaaagatacggcgaaattcaaccttgttgatccacctttgagaaacacagtggctgtgcctgtaaatggatgggcagttattcgatttgtggctgataacccaggtgcatggcttttgcattgtcacttggacgttcacattggatggggtttggctacggtgttgttggtggagaatggagttgggaagttgcaatccatagagcctcctcctgtggatcttcctctttgttag

SEQ ID NO: 260 - DNA, 596 bp, Glycine max
ctgaatctgtaactcaatgtccaatacgtcctggtggaaagtatacctatagatttaacataacaggacaagagggtaccctatggtggcattcccactcttcttttctacgtgcaaccgtctatggagctcttatcattcgccctagaagaggaaactcacacccattcccttcagtttaccaagaagtccccatattgcttggggaatggtggaatggtaatgttgttgatgtggagaacaacgcaattgaaaccggtattggtccaaatttgtcagatgcttacacaattaatggcttgcctggagatacttacaattgctcccaaaatcagacataccaactccaagtgaaacatggagaaacctacctgttgcgcattatcaacgctgcactcaatgcacaacacttttttaagatagccaaccacacattcacagtggtagccatcgatgcttcctacactcaaccctacaacaccgatgttataatccttgccccaggccaaaccgtggatgcaatcataaccacaaaccaaactttgggttcttattacatggccttcactccatatcattccgccccaggcgtttca

SEQ ID NO: 261 - DNA, 2166 bp, Glycine max
atggaaaataagcacacagaaacaagtctctacatgtgtggagtccttgttgttgtggtgtgccggaaaacaaattcaacagttcattgaataacataaccatctaggtgcaccttcacactttctcactgaagctttatagagtcatataggttgataattcagagaaaagcttctatcctactatttctttggattcgccacttcatcaacatgaagctttctgtgttctggtttgcatgggctttttctcttctaatttccatggcttctgctgctacagtagaacacactttcattgttcaaaacaaggctgtcacactcttgtgcaaagagcgagtgattgtcacagtgaatggactttaccctggaccaaggatagatgtccgagaaggggacgctgtggttgttcacgtaatcaacaagtcaccctacaatatcactattcattggcatggagtgtttcagctctttagtgcatgggcagatggtcctgaatatataacccaatgcaatattcgtcctcaaaatagttatacctataaattcaatgttatacaacaagaaggtacattgtggtggcatgctcactcaggagttttacgtgccacggttcatggtgctttcatcattcaccctcgttcgggtctgtttccttttcccaaaccccacaaacaagtaccaataatattaggtgattggtatgacggtaatattgtggatatttatcagcaagtactccttctcggggatgtaaggccctctgctgcctacaccatcaatggtttgcctggtgatctctacaattgctctagaaatcagatgttcaagctaaaggtaaagccagggaagacctacttgctaagaatgatcaacgctgcattcaataacaaccttttcgtcaagatagccaaccacagcttcacagttgttgccatggacgcttcctacatcgaaccctatgtgaccgacatcatcaccatcgcccctggccaaactgctgacgtgctcttcaaagccgaccaacccataggctcatattacatggcagcctctccttacgttgtgggccagccagaagccctattcgacaccacgacaactcgcggcattgtcgcttacgaaggctacacgacatcatcaaaaaattattcaaagcccattgtgccaatactcccacacttcaacgacaccccaattgctcacaaattttttagcaacatcacgagcttgatgggggccccacattgggtcccggtcccacttgaggtggatgagcacatgttcatcaccattaacataaaccttgaaaggtgtcccaagaatggcacgtgtcaaggtgtgtttggacagaaattctccgcaagcatgaacaacgaatcatttgtgcaccccgttggaaaaggatactctatgttggaagcatcgttttacaatgtgagtggtgtgtatactactgatttccctgacaagcctccaatcatattcgatttcacggaccccaaaattgctttggatacgaagtatttgtttacgccgccaaaatcgaccaaggtgaagaaactcaagttcaattcgaccgtggaggttgtgtttcaaaatacacaaattatgaatgcgcaaagccaccccatgcaccttcatgggtttagtttccatgttttggctcaagattttgggaatttcaattacaccaaagataaatacaagtttaatttggtgaatccaatatttcgcaacacgattgctgtgccagttggaggatgggctgttataagattcaaagctaacaatccagggatgtggtttgtgcattgccatgtggatgatcatcagttatggggactagacatggttttcgaggttgagaatggaccaactccttcaacttctctccctccaccacctgctgatctacctaaatgttagctatatattttcctggagaatgcaatcacaaaatcacatgtcaatattaatttcccctcttctttttcagtgtatttagtaagccattttttttaaatttcaagcaataaattaataatagtttcacttaaacacaacatcaagcaagataagtaaaccagaattatctgtaaattcttgctataattaattaataaaagtaccttactgctaaaaaaaaaaaaaaaaaaaaaaaaa

SEQ ID NO: 262 - DNA, 2105 bp, Glycine max
ccgggaaaactccaagtaaacttattcatagcaatagtcttatcctatcatttagtttccccgcctaaacatgaagctattctcgttttctctagcatgtgtttttgtttttgcccttctagcttcttccctggcttcagcagctatcgtggaacacattttcaaagttcaaaacacgactatcaaacgtttttgcaaggagcaagtgattgtgacagttaatggacttttcccagggccaacgataaatgtccacgaaggtggcactgtaattgtccatgtattgaacgagggaccgtatgatatcactcttcattggcatggagtgttacagctctttagtccttgggcagacggtcctgaatatataactcaatgtacaattagacccagaagtaaatacacatataaattcaacgtgacacaacaagaaggaacagtatggtggcatgctcatgcatcatatttacgagcaacagttcatggtgctttcatcattaagcctcgttcaggccgatttccatttcctaaaccgtacaagcaaattcctcttatattaggagacttgtataattctagagttgaggatattactactgaagcacaggccagtggcggacgaccaaacatatcttacgcctttacaatcaatggttttactagcggccttctcattaataattgtactgaaaatgagacatttaagatgaaagtccagcaagggaaaacctacatgctccgaatgatcaacgctgcactcaattacgacctattcttcaagatagcgaaccacaatttcacagtggttgccgtcgacgcctcctacaccgaccactacgtcaccgacctcatcgtcattgcccccggccagagtgctgacgtgttattcacagcgaaccaacccatcggctcgtactacatggttgcatctccttacgttgttggtctcgatcactttgacgtcaacgtaggtcgcggcacggtcatttacgaaaatgccccgccgtcaccaaagcccgtgatgccaattctaccccccttcaacgacacggacacagcttataacaaattctacaacgtcataactagcaaggtgggggcccacactgggttcctgtgcctcgtaaggttgatgagcacatgttcattaccattgggttcaacacagaattttgtgattccaagaatcccaacaatgcctcgtgtaagggcccaaatggtcaaagattttctgccagcatgaacaacgagtcatttgctgttcccgcgggtgtgaagttttctttgttggaagcattctatgaaaacatgagtggagtttacactacggatttccctaacaagccaccagttatgttcgacttcacaaatctgaacaacgctaataatatgaaccttctatttgcgcctaaatcaaccaaggcgaagaaactcaggttcaattcgacggtggagattgtgtttcagaatacagcacttcttgggggccagaaccaccccatgcacattcatgggtatagcttccatgttttggctcaagggttcgggaatttccacaagaaggatagggctaagtttaatttggtgaatccgcaatttcgcaacactgttggtgtgcctatgggaggatggactgtgatcagattccaagcaaacaatccaggggtttggcttgtgcattgccatatggaagaccatgtgccatggggactagccatgatttttgaggttgagaatggaccaactccttcaacttcagtccctccaccacctgctgatctacctaaatgttaatcaggttgcagagtacagtactacttatgattagaaatcaacaccatctgtcgcattttcttctgtgtcataagtatatctagtggtatctaatgttaccaaatggcatcatcttgccagcaaaaaataatttctagtagaaatgtttaggaatttccaagtgaaatgaccgatcgaccttggaagtcaataatataaataatagttattgttttatgtggaaaaaaaaaaaaaaagcacattctcagggtcgcagtcctcgaggagcgtctcgctatgttaaacacaataaagttggaactggagggggg

SEQ ID NO: 263 - DNA, 860 bp, Glycine max
accgggaatggactgggccggacccacgcgacggctcgagatttattaaactacattttttgttacaacatgaaacgttttgtgttttctctggcatgggcttttgctctttttctagcatgttccttggcttctgctgctgttgtggaacacattttcaatgtggaaaacattactgtgcaacgtttgtgtcgtcaacaagtgatcactgccgtcaatggaaccctgccaggaccaacaattaacgctcgagagggtgacactgtagactatcacgtattcatcagctaactaggcccccccaccccccattggcacggaatttttcaatttttaacaccgtggtcagacggtcctgaatttgcaactcaatgcccaatagcttctggtagcagttacacatacagatttaacctaactggacaagaagggactctttggtggcatgcacactcatcttttctacgtgctacggtctatggtgctcttctaattcggccacgactaggacactcgtacccgtttcctaaagtttatcaagaaatccctatactagttggagaatggtggaatgctaatgttgtagaggttgagcaaaatgcaacagaaactcaacagccgccaattgaatcagatgcatatacaattaatggtttacccagcgatctctataactgctctcaggatggaacataccaggtcaaagtaaagcaaggaaaaacctacttgttgcgcataatcaactctgcactcaataatcaacacttttttgaagtagccaaccatacattaaccgtagttgccattgatgctacctataccaatcactacgacaccaaggttgtagtgcttgctcctgg

SEQ ID NO: 264 - DNA, 615 bp, Glycine max
  misc_feature (592)..(592): n is a, c, g, or t
attcattggcatggggtgtttcagctgtttagtgcatgggcagatggtcctgaatatgtaactcaatgcacaattagtccgggaactaagtatacttataaattcaatgtgacacaacaagaaggaaccttatggtggcatgctcatgcatctgttttacgtgccactgttcatggtgctttcatcattcaccctcgttcagggcaatttccctttcctaaacctttcaagcaagttcccattatattaggtgattggtatgatgctaatgttgtggatgttgaaacccaagcactggcctccggtggtcctccaaatgtatctaatgctttcacaatcaacggcttgcctggcgatctcttcaattgttctcgaactcagacattcaagatgaaggtgaagcaaggaaagacctacatgctacgaatgatcaatgctgcactcaataaccatcttttcttcaagatagcaaatcacactttcacatttgttgccttggatgctgcatataccgaccactacatcaccgaaatcattgtcattgcccctggccaaaccattgatgcactattcacagcaaaccaacccttangttcatactatatgagctgcatc

SEQ ID NO: 265 - DNA, 2143 bp, Glycine max
cttcagcattcacactaaggtgttaattgctcataaaaaaaatggagtctgtcaagttcattaacatgaatgccaaacactcctccatcttcttattagccatgatctttgttctgatcttagcttcagcaaatgccaaaattcacgagcacgagtttgttgttgaagcaactccagtgaagaggctgtgcaaaacccacaacagcatcaccgtgaatgggcaatacccgggcccaacgttggaaatcaacaatggagacactttggttgtcaaagtcactaacaaagctcgttacaatgtgaccattcattggcacggtgttaggcaaatgagaacaggatgggcagatggaccagaatttgtgactcagtgcccgattcgtcctggaggaagttacacctaccgttttaccgttcaaggacaagaaggcacactttggtggcacgctcatagctcatggttaagggccactgtttacggtgctttaatcattcgtcctagggaaggagaaccctaccctttccccaagcctaagcacgaaacacccattcttcttggggaatggtgggacgcaaaccctattgatgttgtgaggcaggccacgcgaactgggggagctccaaacgtgtctgatgcatacactatcaatggtcaacctggtgatctttacaagtgctctagcaaagacactaccattgttccaatccattccggcgagactaaccttctacgtgttatcaatgctgcactcaatcaacctctcttcttcaccgtcgcaaaccacaaactcaccgtggttggcgccgacgcctcctacctcaaacccttcaccaccaaagtcctcatgctaggacccggtcaaaccaccgatgtattgatcaccggcgaccagccaccttccccctactacatggcggcgcgtgcgtaccaatctgcccaaaacgccgcgttcgacaacaccaccaccaccgccatactcgaatacaagtcacctcatcacagtaatcattctcaccatcattccaaaggagcactgaagaaaaaaaccaaaccgatcatgccctcactccctgcctacaacgatacaaacacagtcactgccttcagcaaaagctttagaagccctagaaaagttgaagtccccgctgaaatcgaccagagcctgttcttcactgtgggcttaggaatcaacaagtgccccaaaaactttggaccaaagaggtgtcagggacccattaatgggacgaggttcactgcgagcatgaacaacgtgtctttcgttctcccgaacaacgtgtccatcttgcaggctcaccacctcggaatccccggagtgttcaccactgattttccggggaagccgccggtgaagtttgattacaccggcaacgtgagtcgttcgctgtggcaacctgttcccgggacaaaggcacacaagttgaagtttgggtccagggtgcagattgtgttgcaggacactagcattgttactcctgagaaccaccctatccatcttcatggctacgatttctacatcgttgctgaggggttcggaaacttcgacgccaagaaagatacggccaaattcaaccttgttgatccacctttgaggaacactgtggccgtgcctgtaaatggatgggctgttattcgatttgtcgctgataaccctggtgcctggcttttgcattgtcacttggacgttcacatcggatggggtttggctacggtgttgttggtggagaacggagttgggaagttgcaatccatagagcctcctccgctggatcttcctctttgttaggatatcatttcaaaataatcgttggtccccaacaattggagttttgcagtttcattttcttagtttggaagctggtttatgtttgcattttgggagggttttttttttgcttcattgcttgttttgattctacgttctttttatagacagataaattgggtttgaaacctaggaaaggtggtgatgcggttttaacccaaatatataccatctaaatagtcatagcccaaccagttaaattgatgatgttatttttccctcagagttcatgttacaaacagattgcaagttttgaatataaatatatcacctggattttattttttttgttacaaaaa

SEQ ID NO: 266 - DNA, 589 bp, Glycine max
  misc_feature (184)..(189): n is a, c, g, or t
  misc_feature (207)..(211): n is a, c, g, or t
ggtgttcgccaattacggagtgcttgggcagatggacctgcctatgtgacacagtgtccaattcaaacaggccaaacttttgtgtacaacttcacagtcactggccaaagaggaacattgtggtggcatgcccacatctcatggctaagaacaactctttatggtcctattgtcattcttcccnnnnnncatgtgccttacccattnnnnnaaacctttaaggaagtccctatcatatttggtgaatggtggaaagcagacacagaaactgttattaaccaagcaatgcaaacaggattggcacctaatctctcagatgcttacaccatcaatggttttccaggttttctctacaatggcaccacaaaagataccttcaaactcaaggtcaaggctgggaaaacttatctcctgcgtctgataaacgctgcactcaacaacgagctcttcttcggcattgcaaaccacacactcactgtggttgaagctgatgcagtatatgtaaagcccttcagaacaaactatgtactaataacaccaggacaaactattaatgttcttctcaagaccaagtctaaggctccaaatg

SEQ ID NO: 267 - DNA, 933 bp, Glycine max
ccacgcgtccggttagagaaggagacagagtactagtcaacgtaaccaaccatgcaaaatataacatgacaattcactggcatggaattaaacaatatcgcaatggttgggcagatggaccagcttacattacacaatgtccaatccagactggtaatagctacacttatgacttcaacgtcacagggcaaagaggaactttgtggtggcatgctcatattttttggttgagagcaactgtgtatggtgcaattgttatcatgcctaaacctgggaccccatttccgttcccacagccagccagagaatttgaaattctgctaggagaatggtggcacaaagacgtggaagagattgaaacgcaagggaatcaaatggggttgccaccaaatatgtcagatgctcatacaatcaatgggaagccaggaccactctttccttgctcagagaaacatacatttgcaatggaggttgaacaagggaagacttacctacttagaatcatcaatgctgccctcgatgacgagcttttctttgccattggtggtcacaacttgacagtagtggaggttgatgcagtttacacaaaaccattcaccactcaaaccattctaattgcacctggtcaaaccacaaatgttctagtcaaggccaaccaagtagcaggaagatacttcatggctacaaggacctttatggatgcaccaataccagttgatagcaaagccgcaacagctatattccaatacaaaggcattccaaacactgtccttccttctcttccttctcttcctgctgccaatgacacacgttttgctttgagttacaacaagaaattaagaagcctaaacactcctcattaccctgctaatgttccactccacgttgatcggaccctcttctaccccatctgctcgtccccaaattcttgcc

SEQ ID NO: 268 - DNA, 1573 bp, Glycine max
gtctatggtgctcttttaattcggcctcgagttggacactcctacccttttcctaaagtatatcaagaagtccccatactgcttggagagtggtggaatgctaatgttgtagaggttgagcacaatgcaacagaatcccaaacagcgccaatcccctcagctgcgtatacaattaacggtttacccggcgattcctataactgctctgaaaatcaaatgtatcagctcaaagtcaagcaaggaaaaacctacttgctacgcattatcaatgctgcactcaatgagcaacacttcttcaaaatagcaaatcacacattcacagtggtagccatcgatgctctctacacccaacactacaaaactgatgttgtagtgcttgctccaggccaaaccgttgatgtcctctttagcacaaatcaacatgtggattcttattacatggcattcactccataccattcggccccacaaatcccaatcaacaactcaacaacaagagggctggtaatttatgagggtgccacatcagtagaaaagcccatattgccaaatctaccggcccaaaccgacacaccaacggcccacaagttctacaccaacatcacagggttggctggtggaccccactgggtcccggtgccacgtcaggtggatgagcacatgttcatcacttttgggcttaactttgacctttgcaaaaatgtttcaacaccaaatggttgctctgcaaggcaacctccactctctgccagcatgaacaatgagtcatttgtgttgcctcggggaaaagggttatcaatgcttgaagcattctataacaatgatgttaacggagtgtacactagagattttccaaatcagcctccgattgtgtttgactataccgacccaaacataacgagcactacagaattagccttcaaaatcgcacccaaatcaacgaaagtgaagacgttgaagttcaattcaactgttcagattgtacttcaaaacacggccattgtctctgcagagaaccaccccattcacattcacggcttcaatttccatgttttggctcaagggttcgggaattacaacgccactagagacgagcccaagttcaatcttgtcaaccctcagatacgtaacacaatttctgtccccgtcggaggatggtccgttgttagattccaagcaaataatccaggtgtttggcttgtgcattgccatttggaaactcatttgccgtgggggctagccatggctttcgaggttgagaatgggcccactccttctttatcagtgcctccgcctccagctgatcttcctaggtgctaagcgcacgccatgcgttcatgactaaaaacatttatagattggttaatgtttatacacatacatactttcataatgtggatttctaatatcatttgtttgattgagaaaaataaggtgtaataaaggaggaaagtttggctattctttcaaccatgtgacttgatggccaattgtactctatcaaataacatatgttaatctgtcattaattatatttttttattttctcgtggaattaactgtttcctgtgtg

SEQ ID NO: 269 - DNA, 325 bp, Glycine max
gtttaatgttgacccagaagcagtcataagtcaagccttgcagacaggagggggacccaatgtttcagatgcatacaccatcaatggacttcccgggcctttgtataattgttcttctaaagatacatacacattaaaggtgaagccaggcaagacatatctgctaagactaatcaatgctgcactcaacgaagagcttttcttcagcatagccaaccacaccctaactgtggttgaagcagatgccagatacaccaaaccatttgacacagacacactcctcatagcccctggccaaaccacaaacgtgcttcttaaaaccaaa

SEQ ID NO: 270 - DNA, 1165 bp, Glycine max
  misc_feature (1050)..(1050): n is a, c, g, or t
gatccaaagaaaaaacaagaagctcaattgtctagttgaagagcttcaaaacaagatttacaagagaaaaaggggaaatgggtattgcttatctcaacatgccaggcttcatgagggcaatgtttattatgttatgtgctatgatgatattgccggaactaacacatgcaaagcatgcaagagtcactaggcactacaagtttaatatcaaaatgcaaaacttcacaaggctttgccaaacaaagagcattgtaactgtcaatggacgatttcctggtcctagaatcatagcaagagaaggagacagaattatggttaaagtggttaaccacgttcaatacaatgtcacccttcattggcatggaattcgccaactgaaaagtgcatgggcagatggacctgcctatatcacacagtgtccaattcagacaggccaaagttttgtgtacaacttcacagtcattggtcaaagaggaacattgtggtggcatgcacatatctcatggcttagaacaactctctatggtcccattgtcattcttcccaaaagacatgtcccttacccattccctcaacctttcagagaagtccccatcatattgggggagtggtggaaagcagacacagaagcagttataaaccaagcaatgcaaacaggattggcaccaaatatctcagatgttcacaccatcaatggtcttccaggtcctgtctccaactgcgcagccaaagaaacattccagctcaaggtgaagcctggaaaaacatatctgcttcgtctgatcaacgctgcacttaatgatgagatgttcttcagcatagccaaccacacccttaccatggttgaagctgatgcagtgtatgtaaagcccttcagcacaaagattggtctgatcacacctggtcaaaccgtcaacgtccttctcaaggccaaatccaaggctccaaatggcacatgtgccatatccacaaggccctatgctacaggtccagcttcttttgatacaccacagccacagggttccttgagtacaagaaaacttcacatgncgagcacaagtcaaacaccaagaagcttcctcttcttagagcagtgttccctaaattcaatgacactgtctttgcaatgaacttccacaacaggggtcgtagcttggccaatgca

SEQ ID NO: 271 - DNA, 800 bp, Glycine max
gagtcttctgcagagcatcatccatcccatccccaggtcataaacccaagtcggactcgccttcctcctcgcccaactactcctctctctcctccgcgcatcgcaccgcaccgggggtcacctgagatcacatacacaatggtgaaggctgtggctgtgcttaccggcagtgagggtgtcaagggcaccatcttcttcacccaggagggagatggcccgaccaccgtgacgggaagtgtcactggactcaaggaagggctccacggcttccatgtgcacgctcttggtgacaccaccaatggctgcatgtcaactggaccacacttcaaccccgctggtcatgtgcatggggcacccgaagatgaaatccgccatgctggtgatcttggaaatgtgacagctggagtggatggtgttgctagcatcaatattactgactgccatatcccccttactggaccaaattcaattgttggccgtgctgttgtcgtccatggtgatgctgatgatcttggcaagggtggacatgagctgagcaagagcactggaaacgctggtgcacgtgttgcttgcggaatcatcgggctccagggctaagatgtcatcttcgccgaccaacgtcgcacagatatgggaaccttttcagaatgcagatttgcaatctctattctaaataagcacatgatctttgatcacttgttagtgtgcaccagtcgtgtcaattcctatgtgttactctgaactttatcgctgtcatttggctatcgagatgtgtgactggaacaaaaaaaaaaaaaaaa

SEQ ID NO: 272 - DNA, 495 bp, Glycine max
tacaatactttgcttggtgcttgtgctcatagggggttaggtgatgaggctgaaatggtgtttaggactatgaatgagagtgggattgttcctgatattaatacttatagttatcttgttcagacgtttgggaagttgaataggcttgagaaggtttcggagcttcttagggagatggagtccgggggtaatttgccggatattacttcttataatgttttgttagaggcttatgctgagttggggtctatcaaagaggcgatggacgtgtttaggcagatgcaggctgcggggtgtgtggcgaacgcggccacgtatagtgttttgttgaatttgtatgggaagcatgggaggtatgatgatgttcgccatatttttcttgagatgaaagtgagcaacacggaccctgatgcggtgacttataacattcttatacatgtttttggggaggacgtctacttttaggaggtggttcctttgtttaatacatggtgg

SEQ ID NO: 273 - DNA, 605 bp, Glycine max
acacaagtaattgtcagcattaatcagcaggaatttccagaatcatacaaataatttgcataccaatcattaattgaaagattggtatgcaattccaatctccaagaccatttccaagacaaagtgaaccttcatgcctcccttttgagatcaggcacataagaaaaggtccccatgagatatctcagtaaaatcagcatttattaggcaattgggcaaatgttcctgcattggggctacaccccacaaccatcatcttcttgaagacagaaaaggctcgatctttgtttcctgacttactatgcccacggatgagagcattataagtgaagacatttggttcaagacccataaattgcagttcctcgaacatctttccggcttggtccaccattccagcatttccaaaatgaagaatcaatgcattgtaagtataaagttcaggagaaattcccctattcttcatttcactaaaaagagaaagagcttcctccaacctacgtgattttccgaggccattgatcataagattgtaagaaacagtatcaggatcgaggccagttaactttagttcctcaaagtagtgcacagcatcatctcgagcc

SEQ ID NO: 274 - DNA, 506 bp, Glycine max
gggatgaaatgatagaaaaaggtgttaagcccactttggttacttgcaacactgttataaagggccatttgcgggctggcaatgtgttaaaggcaaatgacttcttcgaaaagatgattttggaaggagtttctcctgattgcatcacgtataatactcttataaatggttttgtaaaggaagagaatttcgacagggcttttgtcttggttaataacatggaagaaaaagggctactgccagatgtcatcacttataatgcaattctcggtggatattgtaggcaaggcagaatgcgggaggctgagatggtgttactcaagatgattgactgtggcatcaatcctgataaatcaacatacacatcattgataaatgggcatgtatctctagacaacttgaaagaagcattccgtttccacgatgaaatgctgcaaagcggatttgtgccatacgaccaattctgatgcttttaccgctgcagctcttgttacagatacctgata

SEQ ID NO: 275 - DNA, 956 bp, Glycine max
  misc_feature (775)..(775): n is a, c, g, or t
  misc_feature (794)..(794): n is a, c, g, or t
  misc_feature (803)..(803): n is a, c, g, or t
gtcaaaggaattgagccaaatcttgttactttgaacatccttatcaattgtttcttgccacttgggccaaatggccttttctttttctagtattgggcaaaattctaaaattaggttatcagccgaataccgtaaccttgaatacactcatgaaaggtctgtgtctcaagggtgaggtcaagaaatcactgcactttcatgacaaggtcgtagcacaaggatttcagatggaccatgttagttacgggaccctgctcaatggactatgtaaaataggagaaacgagatgcgccgtcaagttgctgagaatgattgaagacagatcaactaggcctaatgtggtaatgtacaacaccatcattgatggcttatgcaaagataaacttgtaaacgaggcttatgatttatattctgagatgaatgctagaggaatttttcctgatgctatcacttacactactctaatatatggtttttgccttgcgggtcagttaatgggagcattcagtttattaaatgaaatgatattgaagaacatcaacccggatgtttatacctttgctatattgattgatgcattatgtaaagaaggaaaggtgaaagaagccaaaaatttattagctgtgatgatgaaagaaggagtaaaacctaatgttgttacttataatactttaatggatggatattgtttagttggtgaagtgcagaatacaaaacagatattacacgccatggtccaaacgggagtaaatcctaatgttcgtagctacactantatgattaatggattatgntagagtaanaggatggatgaggccatgaatctcctaagagaaatgctgtataaagatatgattcctgatacagtgacatacagttctcttattgatgggttctgtagatcagggagaattacttctgccttgaatccttttgaagagatgcaccacagaggt

SEQ ID NO: 276 - DNA, 986 bp, Glycine max
gtctgactccagattgtgttacatataactctgtaatgaacacatatttcatacaaggtaaaacagaaaatgctttggatctgttgaatgagatgaagagctatggggtaatgccaaatatggtcacttataacattcttattggtgggctttgtaaaactggtgcaattgaaaaagtaataagtgttttgcatgaaatgttagctgtggggtatgttcctacacccattattcacaagtttctgcttaaagcatattcaagaagtagaaaagcagatgcaattttgcaaattcacaagaagcttgtggatatgggccccgctccctacccccccccccccaacacactaatcactgtattatgcagattagggatgactaaaaaagcaaatgtggtgcttacggaaatggtgataaaaggaatttcagctgacattgttacttataatgctcttattcgtggttattgtacaggcagtcatgtggagaaggcttttaatacttattcacagatgttggtgagtggaatctctccaaatattactacttacaatgcccttttagaaggtctttcaactaatggtttgatgagagatgcagataaattagttagtgagatgagggaaagaggacttgtcccaaatgccactacttataacatattggtttctggccatggtagggttggaaataaacgagattctataaaactttattgtgaaatgataaccaaaggttttattcccacaacaggtacctataatgtgcttattcaagattatgcaaaagcaggaaagatgcgccaagctagagaacttttgaacgagatgttgacaagaggaagaattcctaattcttcaacatacgacgttctaatttgcggatggtgcaaattgtcctgtcagccagagatggacaggttacttaaactgtcatatcagaatgaggcaaaaaattgctgagagaaatgtgtgaaaaaggacatg

SEQ ID NO: 277 - DNA, 2464 bp, Glycine max
cttgttcaatgttttgattaggcagaataaggtagttgatgctgttgttttgtttagggagcttatcagattgcggtataagcccgtgacctacacagtcaatattttaatccgagggttgtgcagggtcggagaaattgacgaggcttttaagcttctcaaggatttaaggagttttggttgtttgccggatgtaattacatataatactctcattcatggtttgtgtctgattaatgaggtggatagagctagaagtttgctaagggaagtttgcttgaatggggagtttgcacctgatgttgttagttacaccatgattatttcgggctattgtaagttgagaaagatggaggaggggagtttactttttgatgaaatgattaattctggaactgcacctaatacgttcacgtttaatgctcttattgatggctttggtaagttgggtgacatggcttctgcactagccttgtactcgaaaatgcttgttcaaggttgtctgcctgatgttgctactttcacttctctaattaatgggcattttcgagttaggcaggtgcaccaagcaatggatatgtggcataaaatgaatgaaaaaaatattggcgctagtttatatacatactctgttcttgtcagtggtctttgcaataataacagactacataaagctcgtgacattttgagactgttgaatgagagcgacattgttccacaaccatttatctataatcctgtcattgatggatattgcaaatctggcaatgttgatgaggctaataaaattgtagcagaaatggaggtgaataggtgcaagcctgataagttgacatttaccattcttattattggacattgtatgaaagggagaatgcctgaagcaattggtttctttgataagatgttggctgttggttgtgcaccagatgaaatcactgtaaataatttaagatcctgtcttttgaaggctggaatgcctggtgaagctgcccgcgttaaggaagttcttgctcagaacctgacattgggtactacatcatcaaagaaatcttatcatgaaaccacatatgtaagtatacctgttgctgtttagtgaagtgctatggcaaagtgcaaaccagtggattgacacggcattccaccattatgcctcgagtacttggtgcaggtgtttccagcttgtggatcaatggcatgctatcatcggacagggtgtctcttgtttctggagattatcagtatttacatttgcattgccattccctccaagtttctgctgattatttttggacctgacattaggtatactctatttaattttgttgagttgatttttcacttttcatggtctcatggctggtctcaagtccaggtagaggaggagggttggatggttgtgacataaaacttgtcaaaatcccaaacatggatttttcatttttcctatagatttgaaaattagtttctaacatgaaataggttttatttagtctctttgtttgtaaaatgtagtgctagtaattgatattcttgttcatatgatagtgcatttgcttcagagtatactgaattctctttgtaagaaattgaataaaatgtgaaacatttgaaaaggggtcttaaggaaattcttttgttcttaggctcggtaacttacaagatagaaggtggttgtatcgtaaaattgttcaagattattgtcattcatgattgtgtagaaagatttaaagacttgggccaaaatgcaaagaaccctctataaccacagttcgattgcagaaaatctcctgtggttcaaaacacaacagcacaactccttgatcttaagtaaaccgtgtattgactccatacaggtggttttatgcacttgcagtggttaaattcactctactctgcaagacttggtaagccttacttgagttgctgagtttttttaaccatatgggagtttttggcaacatatagttggtacacttttacatttgacaaggtatttaatcatggggcttctcaacaagatgcttttattgagatatcacaactggtacaaagtgcgcttcatgggtacaaggatacccctcaaccgatgagaagttgtttactcacaaaattagacttcaatttgatgaactgagttatttgaagacaaactggctccatggcaattggaaccaaagtgtggccctctatcaaagcctagcaagcttaactgcggagctagcattggggtggtttctttgatgctctgcttttagtaggttaataatcctattggatcatggttcagagtaatttctagaagggtatcgttatttgcagtttgacgcccctttttctctatttgatgcactccttataagaataagatgtcctagatacactccttttataagttatttaacgaatatcttattcttcaaaaaaaaaaaaaaaaaaaaaaaaaaaaaaaaaaaaaaaaaaa

SEQ ID NO: 278 - DNA, 579 bp, Glycine max
tcagctacgtaggccccccccccaaaaactcctcacattctcactttcactctcagcccccatccattcaaaatgttgacgatgccgtttcactctctgtattgaccaagattctcaagaggggttacccgcccgacaccgtaaccttgaatacactgatcaaaggtctctgtcttaagggacaagtcaaggaagcactgcactttcacgacaagctattagcacaaggatttcaactcaaccaagttagttacgcgactttgatcaatggagtatgtagaataggagacacaagagctgccatcaagtttctgagaaagattgatggacgactggctaaacctaacgtggaaatgtacaacacaattattgacgccctgtgcaaatatcaacttgtaagtgaggcttatggtttattttctgaaatgactgtcaagggaatttctgctaatgttgtcacttatagtactctaatatatggcttctgcatcgtgggtaagttgaaagaagcacttggtttgttaaatgtgatggtattgaaaactatcaacccaaatgtttgtacctataatatactgg

SEQ ID NO: 279 - DNA, 2903 bp, Glycine max
acgagctcaactgctaaactaaggtaccctttcctgtccttcaaacttgtcgacttgtttcctaactattatgaacaacaccatcaactatgcagcatgcactatggtatagtttacttctgagtcatcataaactgtatcttaatgctgaaaactgacgacgtgatcatctaattgatatttcaactgtttgctttgtcagttacaattgggtgattgtttgttccttctgtattattgttgctatatatagatagcaaattcccatgatccacgttcagcttctaaacttcccaccccaaacataatgttgagttatggattttcttcttggctgtttatttaaggattacatttttacattttgtgcaccagtttgttaataaaatgaagatttctggagcaaatgtgactgggtgtggggtttgccagtttgtgtatggattttaagaataatccaggatgaggcatctccgttattatgtgccggtataattaagccagcactccggcttggtcttgtagccagaatctgattctggctagaatagtagtttgctgaggctttcagaagcagtcaagaatcaagatagatttctgagaatcagatcaggtctactcattagtcatggatagcagcaagaagggagccctcatgagtaatgaaagcgcaaaagatttatcagtcatgcatcagtacaagaagaaccaaccaaagttaagttctaccccgcaagagagacgtgatcaatcccactgccttatctgtaggggaaacaacagttgtcaaacagttcatgcaagaacaaaactgatgaatactttgattggaaaagggaagccacatgaagctcaggccgtcttcaacaacttaactgaagaagggcataagccaactctcataacatacacaactcttgtggctgctctaacccgccaaaagcgtttcaagtctattcctgcacttctttctaaagttgcagacaatgggatgaagcctgattcaatacttctcaatgctatgatcaatgccttttctgagtctggcaaggtagatgaggccatgaaaatctttcagaaaatgaaggagtatggatgtaaaccaacgactagtacttataatactctcatcaaaggatttgggattgctggaaggccttatgaatctatgaaattgctagagatgatgggtcaagatgaaaatgtgaaacccaatgatagaacatataatattttcatccaagcctggtgtaccaagaagaaactggaagaagcatggaatgttttgcataaaatggtggcttctggcattcagcctgatgttgtaacatacaacaccatggcaagggcatatgctcagaatggtgagacagagagggctgaaaggctaatattgaaaatgccgtacaacatagtgaaacctaatgaacgaacttgtggcatcataataagtggttattgcaaggaaggcaatatgccagaagccttgaggtttctatacagaatgaaggagcttggtgtggatccaaatccagtagttttcaactctcttatcaaaggatatctagacactacagacacaaatggagtagatgaggcactgacgttgatggaagaatttgggatcaaaccagatgtagtaacctttagcaccatcatgaatgcatggagttcagcagggcttatggaaaattgtgaggagatattcaacgacatggtgaaggccggtatagaacctgacatccacgcatatagcatccttgcaaaaggctatgtgcgtgccggacagccacgaaaagccgaggctcttctgacttctatgagcaaatatggcgtacaaccaaacgtggtgatcttcactaccatcatcagtggatggtgtgccgcaggcaaaatggatcgtgcatttagactttgtgagaaaatgcatgaaatgggaacttccccaaatttgaaaacttatgaaactttaatatggggatatggagaagcaaaacaaccatggaaagcagaagagttacttactactatggaagagaggggtgttgtccctgaaatgtcgactatgcaactggtggctgatgcttggcgtgccattggtttattcaaagaagccaacagaattcttaatggttcagaagaagaatctgagctagatcaagaatttgatagtgacaagatacaagtgcaaagcttggagagtatttataagaaacagaaactcagtgcttctccctctaatctgcttcaaatacctgacgtagtggtgactcatccaacaagaacaactaatggaaacataagatgcagaatggtagtcaaactatctgacaacatgcggaatgttaccacttccatgttttttgttcgcacaagaagttcatatggagtgcaaccactgattgtaagtaggcagcagattcaaaatcaggttgttaggccattccttgactgttgcagagtagtgtcaatactttgttgaggtgacttaccactgtgatgaaacacaaatcctttctgaatagatttggttgtttccatgacagtacaccatgccaatgagttcaggtggaaaaactgtagataccattcatggacttcagaaatcagaacatacacttacaattttgacaaaatgctggtgtaatttcaattgttgaactgctgctactcgtattcagtaatcacttgccaatgaaatgtgtatcctattacatcactataaaattcgttttgtattgttgtgtacactgagcattgttggaaaatcttacttttataaatagtacttataaggaaaacactgaaaagaatagataccatattaatcaaatgaaattgcacgagaccaacatgcttacttagattacatatgagaagagaccattattaaattcatggct

SEQ ID NO: 280 - DNA, 381 bp, Glycine max
atgtctcagggaagaggcagtgcatctttacctattgtggtcactgtggtttcactactgtgccttttggttcttttggaacgtgctgatgcagcaacttacaccgttggaggacctgggggatggaccttcaacactaatgcttggcccaaaggaaaaagattcagagctggtgatatcctaatcttcaattatgattcaacgacccacaatgtggttgctgtggacagaagtggatacaacagctgcaaaacgccagggggtgctaaagtgttcagttcagggaaggaccaaatcaaactagcaagagggcagaactacttcatatgcaactaccctggtcactgcgaatctgggatgaaagttgccattaatgcagtg

SEQ ID NO: 281 - DNA, 905 bp, Glycine max
tacggctgcgagaagacgacagaagggggacacaatcaatcccattattaaagggataagccttcaaccttgcaacacaacactacaacctaaggtctgcactacgagaatgtctcagggaagaggcagtgcatctttacctattgtggtcactgtggtttcactactgtgccttttggttcttttggaacgtgctgatgcagcaacttacaccgttggaggacctgggggatggaccttcaacactaatgcttggcccaaaggaaaaagattcagagctggtgatatcctaatcttcaattatgattcaacgacccacaatgtggttgctgtggacagaagtggatacaacagctgcaaaacgccagggggtgctaaagtgttcagttcagggaaggaccaaatcaaactagcaagagggcagaactacttcatatgcaactaccctggtcactgcgaatctgggatgaaagttgccattaatgcagtgtgatggtgcttaatacttcttgagttgaagtgaaaattaagttaatggtcaattagctagcattagtaaatgttagtgtgtgctcatgtatgtactttttttatatgaagctgttatatatatttattaatcactatagttttgtgaagcaaagtgggagtgagctggcttggtagatcaattgttcctatgtttggtatgtgttgtgtagtgggagtataaaaatggtccattagtcacgggctcttcttattagacattggatctacatattttgaagttattgaaagtctcagagccaattatctgtatctgtgtgtcggtgtcacagtgtatggttctattactgattttgtttgcttcaataaattaaatttcctaaaaaaaaaaaaaaaaaaaaaaaaaaaaataaaaa

SEQ ID NO: 282 - DNA, 1896 bp, Glycine max
cccacgcgtccgtacggctgcgagaagacgacagaaggggacaaccaattccattattaaagggataagcctcaaccttgcaacccaacacaaccaaaattcgctacttgttaagggctgcactataccagaatgtctcagggaagaggcagtgcatctttgcctattgtggtcactgtggtttcactactgtgccttttggaacgtgctaacgcagcaacttactccgttggaggacctgggggatggaccttcaacactaatgcttggcccaatggaaaaagattcagagctggtgatatcctaatcttcaactatgactcaacgacccacaatgtggttgctgtggacagaagtggatacaacagctgcaagacaccagggggtgctaaagtgttcagttcagggaaggaccaaatcaaactagcaagagggcagaactacttcatatgtaactaccctggtcactgcgaatctgggatgaaagttgccattaatgcgctgtgatatactagtagtgctcaatacttcttgaaatgaagtaactgttaagttaatggtcaattaactagcattagtaaatgttagtgtgtgatattgtatgtagtcttttttttatatgaagctgttatatatattaattactatagtttgtgaagcaagtgggagtgagctggcttggtagatcaattgtgatattatcagtatgtggacccatagagagtaccattatgaacaatcaggaaagcatgtgattaataaagattgaatctgtgaatgcaggattagtaacatgcagttggaactgacattcatcaattggtataagtatcgtgaacacgttaagatcatcattagtaaattagcatagatctgagtctaatctcttttccccatgcagtcttctcttcataaccacagctaataacatgaatggcctctttgatcagcatcgagggatcagaagattcaggaagtcctccattctccatcagtgtagattcaatgaaaacagtggacaaaccaaatgttttctcaaagctcatttgtgaaatcagcattgacctctcgtattcatcatagtctgcaagaagtaaaaaagaaacaagaagtattttcctcattgaagagtctgctacgtgtttaagtaaaactggtagacaaaactagctagctgtgcttactgtcaatctccctgagattaaaaatggcggcatcaagttcttccctctttgcatctctataaagctctgagactcgtttggtttgcttctttgaggggcagcaacagcaggatgatgattttggtaatttgggcatagatggtggactgtagccataaagtgcttgtctattgaaaacacatccagttcccacatacataggtccttgaatgccatcaagtcctttcatgttaacctgaaagtgatcaaggttggaaactacaataagttttgtgtccatgatttttacttcatacaagttatgccaccattttaatattgttaacaaagaaaaattatctggacatagaagcagataaattccaaattaattggactttttatcattcacaaaaagaaaacacataaaggtttgaatgcttctttgatgggtcaatatttcttccacactgaggctacaatagttattaagttttaaaactcttaattttatttaaacttacatcaaagaaaactgtgtttcgattggcatatcgatcactacgatctataccatcaaatctctggggaaactgcacataacacaaatctctgccaactactggatccatcagaaaacacattgcttcccgtacagccttgctattgttcacataatgatcacagtcaagattagaataagggagcatttgtagaactgcaggcatgcaag

SEQ ID NO: 283 - DNA, 651 bp, Glycine max
  misc_feature (576)..(576): n is a, c, g, or t
  misc_feature (604)..(604): n is a, c, g, or t
  misc_feature (606)..(606): n is a, c, g, or t
  misc_feature (613)..(613): n is a, c, g, or t
  misc_feature (622)..(622): n is a, c, g, or t
  misc_feature (628)..(628): n is a, c, g, or t
  misc_feature (633)..(633): n is a, c, g, or t
  misc_feature (637)..(638): n is a, c, g, or t
  misc_feature (647)..(648): n is a, c, g, or t
caacaacactacaaccaaaattcgctacttgttaagggctgcactataccagaatgtctcagggaagaggcagtgcatctttgcctattgtggtcactgtggtttcactactgtgccttttggttcttttggaacgtgctgacgcagcaacttactccgttggaggacctgggggatggaccttcaacactaatgcttggcccaatggaaaaagattcagagctggtgatatcctaatcttcaactatgactcaacgacccacaatgtggttgctgtggacagaagtggatacaacagctgcaagacgccagggggtgctaaagtgttcagttcagggaaggaccaaatcaaactagcaagagggcagaactacttcatatgcaactaccctggtcactgcgaatctgggatgaaagttgccattaatgcgctgtgatgtactagtagtgctcaatacttcttgaaatgaagtaactgttaagttaatggtcaattaactagcattagtaaatgttagtgtgtgatattgatgagtctttttatatgaagctgtatatatataattactatagttnggaagcagggggaggaactggcttggtnanaattgtnctgattggnatggtnggtgnggannttaaattgnnctt

SEQ ID NO: 284 - DNA, 896 bp, Glycine max
agaaaaagtcatgtttgtgtcatcaaataacaaagatagcttagccattgggtaggggtggaatataagcgaaattttgttttttgattattttttagttttgtttagtcatttgtttacttcaattattattattattattattattattattattattaaaaaaaaaaaaaaaaaactcgagactagctctctccctcgtgccgaattcggcacgaggtcagctacgtaggcccccccccccccccaaaaaaacaaatctccttcttgaactcaaggagatggctctgggaagaggcagtgcagtggttctactactttgcttcttgctgcttcactctcagatggctcgtgctgccacctacacagttggagattctgggggttggacctttaacactgttgcctggcccaaaggaaagctctttcgggctggtgacacacttgctttcaattatagccctgggactcacaatgtggtggccgtgaacaaggctggatatgatagctgcaagactccaagaggagccaaagtgtataagtcagggacggatcagatcagacttgccaagggacagaactacttcatctgcaattatgttggtcactgcgagtctgggatgaaaattgccatcaacgctgcctgagtttaataatatggttaactacccatacatattgtattgtaatgcaaattgcaccctttagtgggaagttagctcctttaaataatgttaagaaaaaaagtagctatgtgtgctcttctataaatgtcacttatctataaagaataaatgtcggcagtcggtgatctcaaaaaaaaaaaaaaaaaaaaaaaaaaaaaaaaaaaaaaaaaaaaaaaaaaagaaaaaagaaaaaaaaaaagaaaagggggg

SEQ ID NO: 285 - DNA, 680 bp, Glycine max
  misc_feature (91)..(91): n is a, c, g, or t
  misc_feature (627)..(627): n is a, c, g, or t
  misc_feature (649)..(649): n is a, c, g, or t
  misc_feature (654)..(655): n is a, c, g, or t
  misc_feature (657)..(659): n is a, c, g, or t
  misc_feature (664)..(664): n is a, c, g, or t
  misc_feature (676)..(676): n is a, c, g, or t
acaacactacaacctaaggtctgcactacgagaatgtctcagggaagaggcagtgcatctttacctattgtggtcactgtggtttcactanctgtgccttttggttcttttggaacgtgctgatgcagcaacttacaccgttggaggacctgggggatggaccttcaacactaatgcttggcccaaaggaaaaagattcagagctggtgagatcctaatcttcaattatgattcaacgacccacaatgtggttgctgtggacagaagtggatacaacagctgcaaaacgccagggggtgctaaagtgttcagttcagggaaggaccaaatcaaactagcaagagggcagaactacttcatatgcaactaccctggtcactgcgaatctgggatgaaagttgccattaatgcgctgtgatatactagtagtgctcaatacttcttgaaatgaagtaactgttaagttaatggtcaattaactagcattagtaaatgttagtgtgtgatattgtatgtagtcttttttttatatgaagctgttatatatattacttactatagttagtgaagcaagtggcagtgagctggcttggtcgatcaattgaacgtgcatttgactagcattantacatgttagtgtgtatattgnttgtnntnnnctttngtttgctgtttntttt

SEQ ID NO: 286 - DNA, 652 bp, Glycine max
actcacctccaaaacatatctccttctttacttagttcaactcaacccaaggagataattaatatggctctgggaagaggcagtgcagtggttctactactttgcttcttggtgcttcagtctgagatggctcgtgctgccacttatagagttggagattctaggggttggacctttaacaccgttacctggccccaaggaaaacgctttagggcaggtgacacacttgcgttcaattatagtcctggggctcacaatgtggtggcggtgagcaaggctgggtatgatagctgcaagacaccaagaggagccaaagtgtatcggtcagggaaggatcagatcagacttgctaggggacaaaactacttcatctgcaattacgttggtcactgcgagtctgggatgaaaattgccatcaacgctgcatgactttcttctctactcatacgcatctattctaacgcaaactgcacccctttagtgggaatcaacttgtctcctttaaataaatggatagatataggacgtgtgtgttatttaagaaaaagggtagctatgtgtgctctcctatgtatgtaacttattatctattgatgattcagaataaatgtcggcagtatatcataaaaaaaaaaaaaaatcacgtaaaaaa

SEQ ID NO: 287 - DNA, 630 bp, Glycine max
  misc_feature (167)..(167): n is a, c, g, or t
  misc_feature (240)..(240): n is a, c, g, or t
  misc_feature (503)..(503): n is a, c, g, or t
aaaaaaaacaaatctccttcttgaactcaaggagatggctctgggaagaggcagcgcagtggttctactactttgcttcttgctgcttcactctcatatggctcgtgctgccacctacacagttggagattctgggggttggacctttaacactgttgcctggcccnaaggaaagctctttcggactggtgacacacttgctttcaattatagccctgtgactcacaatgtggcgaccgngaacaaggctggatatgatagctgcaagactccatgaggagcccgagtgtataagccagggactgatccgaccagacttgccaggggagaaaactactccctcctgcattatgttgggccctggcaggctggaatgaaaattgccatcaacggtggccgggcctaatattaggggtaaccttccccaccatattggatggaaaggccaattgctccccttaagggggaaattagccccctttaatttaaggttaaaaaaaaanaaaagccaagcgggggccctttctaataagggcccccttatctaataaaaaataaattggcccgcggcgcgaaaacaaataatataaaacaaggtttatccatataccccgcgaagcctcgaggggg

SEQ ID NO: 288 - DNA, 776 bp, Glycine max
tctcgagccgaatcggctcgaggttttccttgtttcccctattattatctcgctctcacaaaatcatggcattctctagtgctttgattctgtggtcgttgctagcaatcaacatggccctgccaaccctcgcaaccgtctacaccgtgggagatacttcaggttgggcaattggtactgattatagcacttggactggcgacaagatcttttcagtgggtgatagtctcgcgttcaactatggagctgggcacacagtggatgaagttaaagagagcgattacaagtcgtgcaccgcagggaattctattagcacagacagtagtggtgcgaccacaattgcccttaaaagtgcaggcactcattacttcatatgttctgttcctggacattgttctggcggtatgaaacttgccgtcactgtcaaatcaggaaaagcctctgatgccacacccactacttccactactaccgccactaaatcaaactcgtcttcagcgagtagtgtctcaccaattgttgctatgttcattgtttcctcgatctcttactatgttttgcgtatgctataagtttccccactcagtcaggacagaggcagtgctttctttctttcttatattattatcactctgttttctggtttgatttatctctgagtactaatccaggtcacttgttgtcgtgtattaattatctaaaaaaaatcccatgtttgtctttcattctttttttttaatatatgcttgtttttatggtgaagagaaacacatgag

SEQ ID NO: 289 - DNA, 1282 bp, Glycine max
cacgcgtccgccttcttgaactcaagagatggctctgggaagaggcagtgcagtggttctactactttgcttcttgctgcttcactctcagatggctcgtgctgccacctacacagttggagattctgggggttggacctttaacactgttgcctggcccaaaggaaagctctttcgggctggtgacacacttggtcagttccaattattctatctcataaatccctcttaagttcttttcatttctcaattccctaccacccactaattgatacctcaattctttgttttaaagaaatttataatacctcaaatctgattctaattaatataaaaatattttgttttaatttaacttggtaagttaaaaaaattattttggttattaaagtattttttgttagactaattaaactgatccttttgtcagattgtatatcaataatattaattttaactgacgtgataaatattgatgataaatactgatgtgacataacattttatagtttgtcacgtgtgactaaattgattacatgagtgtaataaattgataataaaagtgacttaattatatagataagtgaagagtgtgttacttaatttttattattaggtaaaattaatacaagtctcttaaaaatatgtgaagagtttgttacagtgtcttccatacagtatataacacatggaagaagtttcattttttataattcttttatatagctaacttttgaaagcatgtgatacattttggtgtatggggtgcatcagctttcaattatagccctgggactcacaatgtggtggccgtgaacaaggctggatatgatagctgcaagactccaagaggagccaaagtgtataagtcagggacggatcagatcagacttgccaagggacagaactacttcatctgcaattatgttggtcactgcgagtctgggatgaaaattgccatcaacgctgcctgagtttaataatatggttaacttcccatacatattgtattgtaatgcaaattgcaccctttagtgggaagttagctcctttaaataatgttaagaaaaaaagtagctatgtgtgctcttctataaatgtcacttatctataaagaataaatgtcggcagtcggtgatctctctctctctccctctctactcctgtgtgtaggtcttacatcagaacttataagtttagtataatacaaacttgcttaggtcactttcattttcacacactaaaaaacaacttaaatataattattgaatcatttggtaat

SEQ ID NO: 290 - DNA, 2075 bp, Glycine max
ctcgagccgaatcggctcgagcggctcgagccttaaccatcactggcacataggtgtttattgctacacactagaagaattatggaagctctcaagaccctcttcttagccatttttgttgtcttggcttccgcattgtattcagccaatgccaaaatccaggagcatgaatttgttattcaagcaacgccagtgaagaggctgtgcaacacccacagcaccatcacagtgaatggacaattccctggtccaacattggaagtcaacaatggtgacactttggtcgtcaaagtcactaacaaagctcgttacaatgtgactattcactggcatggaattcggcaaatgagaacaggatgggctgatggaccagaatttgtgactcagtgccctattcgtcctggagaaagttacacctatcgttttaccattcaaggacaagaaggaacactttggtggcatgctcatagctcatggctaagagccactgtttatggtgctttaatcattcaccccagggagggagaggcgtatcctttcactaagccaaagcgcgagactccaattcttcttggggagtggtgggacgcaaacccgatcgatgttgtgagacaagcttcacaaacaggagcagcacctaatatttctgatgcatacaccatcaatggtcaacctggcgatctttacaagtgttctagccaaggcaccaccattgttccaatagattctggcgagacaaacctcctaagagtgatcaatgcagcactgaaccaacccttgttcttcacagtggccaaccacaagctcacagtggttggtgccgatgcctcctaccttaaacccttcaccaccaacgtcatcatgctgggaccaggccaaaccaccgatgtcctcatccaaggtgaccaacctcccacacgctactacatggccgcacgtgcctaccaatccgcccaaaacgcaccgtttgacaacaccactaccaccgccattctcgaatataaatccgcaccgtgccccgccaagggttcttcgatcaaacccgttatgccgtctctcccagcctacaacgacaccaacacagtcactgctttcagcaaaagcttcagaagccccagaaaagttgaagtccccgcagaaattgatgacaatcttttcttcaccattggccttggactcaacaattgcccgaaaaatttcaatgcgaaccaatgccagggaccgaatggaacgcgtttcactgccagcatgaacaatgtctcgtttgttctcccaaacaacgtttcaatcttgcaggctcatcaccttggtgtgcaaggagtgttcaccactgattttcctacgcaacctcctgtcaagtttgattacactggtaatgtgagtcgttctctgtggcaacctgttcaagggaccaaagtgaccaagttgaagtttggatcgagggtgcagattgtgttgcaggatactagcattgtgacccctgagaaccaccccattcaccttcatgggtatgatttctacatcgtggctgaggggtttgggaattttgatccgaacaaagatacttccaagttcaaccttgttgatccacctatgaggaacactgtggctgtgccagtgaatggatgggcagttatcagatttgttgctgacaacccaggagcttggatcatgcattgtcacttggatgttcacatcggatggggtttggccgctgtgcttttggtggataatggagtaggcctgttgcaatccatagagccccctcctgaggatctgcctctatgttaggataatcaaaatcaaaattattgaatttgttaccatagttcagttccaaaattttcctagttcattgttgtttccctgtattggaggtatttctccttttgcttttattttgttgttcttttcatatagagataacccgggtttaaaagagacggtggtgtgtgatttcaacacggaatgccatcttatatggtcacaagcccgattgattaaattgatgtcggttgttttcttccccttgtggttaatgttattaagaaagatgattttgactaaaaaaaaaa

SEQ ID NO: 291 - DNA, 2344 bp, Glycine max
ccacgcgtccggtctaaaagtagctgcactttagaacaaatcagctacgtaggcccccccccccttcacagcccaagaaactccattaaacaaaaccagagcaacaatgaagactttccaactctctggtaagttatgttgctcttggttcttacttggcctgcttgctcttattggttcccttgcttcagctacagagattcatttccatgaatttgtcattcaagctaagccagtgaggaggctgtgcaaaacccaaaacataatcactgtcaatgggcagttcccagggccaacagtggaagctagaaacggggattttgttgtaatcaaagtagtaaatgcagcacagtacaacatctccatccactggcatgggttaaggatgctgagaaatccatgggcagatggaccaagttatgtgactcagtgtcccatccaaccagggggaagttatacataccgatttagaatcagggaccaggaagggacactatggtggcatgctcacaccggcttcctaagagccactgtttatggagctttcatcatctatcctagattgggttctccttatcccttctctatgcctaagcaagaagttcccctccttcttggggaatggtttgatacggatcttgtgcttctccaaaggcaggcagattttgcaggattacctccaaatacatctgttgcatacaccattaatgggcaacctggtgatctgtacagatgctcaagccaagaaactgttcgtgttccagtagatgctggggagacaattatgttgagaatcatcagcagtacacttaatcaagaactcttcttctccattgccaaccacacaatgactgttgttggtacggatgctgcatatactaagcccttcaaaaccacagtcctcatgataggacctggtcagacattcaatgtcatagtcactgctgatcaacccccaggtttctactacatggcggcacatgcctatgaatcagctgtaaatgctccctttgacaataccaccaccactgcaatccttgaatacagatctactagacgcagaaaccaaaacagatcaagaccagttttgccagctttgccagccttcaatgatacccccactgcaactgcattcactgctaggatcaggggtcttacccgggttagagtctttaagaaagttgatgtgaatctatatttcatagtgggattggggttaatcaactgtactaatcctaatagtccccggtgtcaaggaccaaatggaacccgcttcacagccagcatgaataatgtatcttttgtactcccaagtactacctccttaatgcaagcctactatgaaggaatacccggtgtcttcaccacagactttccccccgttccccctttacaatttgattacactggcaatgtgccaccggggctatggacaccttctcgaggaactaagctctacaaggtgaagtatggctccaaggtgcaaattgttctgcaggacacaagcatagtgactactgaggaacaccctatgcatgttcatggattccacttctttgtagttggttcaggttttggcaacttcaacccagcaactgatcccctcaagttcaaccttgtagacccacccgtgaggaacaccattggaacacctcctggaggatgggtggccattcgttttgtggctgacaatccaggaatttggtttgtccattgtcacatagactcacatctgaattggggtttgggaatggcacttctggtagaaaatggagttggcctttcacagtcagtattacctccaccaccagatctaccccaatgttaaggttaatgaagcatcattagttaataaatttattgttctgtattacaagttctacaagaatttgccaaacaaacagtatggctttctgcagtttccaataccagaattagattatgcttaattgagctgtatgttggcggtatgttgattaggtggcattgcaaacctatactaacaaaaataaaatttaaatgatttcttttcattactacaaaaaaaaaaaaaaaaaatgccacagtgttaagaccaagaaagcatcattagtcaaaaaaagttatttaatttcctcaattattggcttgttgttctagtgttttaccaggtctttaaatacttgcaaaatagacagtatttgtcctgtatttcaaggtccagaattggaccatgctcaattgagcagctatgtttgtgtttttcttgattgagtgcaaggtgatagtgcttttagaacaaaaaatagcataacttgtgatctctcgtcattactattaagagttactctttttcttttaaaaa

SEQ ID NO: 292 - DNA, 663 bp, Glycine max
atggggagaggaaagatcgtgattcgaaggattgacaattccactagccggcaagtgacgttttccaagagaagaaatgggttagtgaagaaagctagagagctatctattctgtgtgatgcagaagttggattgattgtgttctccagcactggcaagctttatgactatgcaagcaccagcatgaaatctgttattgagcgctataacaaggtcaaagaagaccatcaacagttaataaatcctgcatcagaagtcaagctttggcagagagaagtagcaagcttgcggcaacaagtgcagtacatgcaagaatgtcacaggcaaatgatgggccaagagctttctggattgggtatcgaagagttaggaaatctggaaaagcgactggagatgagtttaaagggtgttcgcatgaagaaggatcaaattctgattgatgaggtcaaagaactacaccaaaagggaagccttgctcatcaagaaaatgtagaacttaatagaaagataaatctcatccgcaaggaaaatgaagaactacaaaaggttattgaagctaagtgtagaaaaggtgttgcagcatccaatcctccattcactatcaactatggatgtaatatgcttgctcctatcagtctccagctaagcctgccagagtcaacg

SEQ ID NO: 293 - DNA, 714 bp, Glycine max
atggggagaggaaagattcccattcgaagaatcgaaaattcgacgaaccgacaagtgactttctgtaagagaagaaatgggttgctgaagaaaactagagaactatccattctctgtgatgcagaagttggagtgatagtgttttccagcactggcaagctttatgaatattcaaacaccagcatggaaacaatcattgagcgctttaacaagcaaaacaataatcatcatcggctaatggatgctacttcagcaatcaagggagaagcagcaagcttgaggcaacaactgcagcatttgcaagaaaaccacaggcaactgatgggtgaagaactttctggtttgggtattaatcagctaaaacatctggaaaatcaactacaaatgagtttgaataacgttcgcaataaaaaggatcacattttcagtgatgagatcaaggaattacaacaaaagggaagcttgattcgtcgacaaaatgaagaacttcataagaagatagaccttatccacaatgaaaatgcagaactaaagaaggttattgaagcaaggcataaggaagaagaaagggcagcactcaaacctccatgtgctatcaaaaatagatatgatacacttgaccctaacagtctgcaacaaaggcagtcccaaccccaacccagtgaaccatcagccgaagtgatgattatggggtactccctcaaattgaagatg

SEQ ID NO: 294 - DNA, 723 bp, Glycine max
atggggagaggtaagattgcgattcgaaggatcgacaactccactagccggcaagtgactttctcaaagagaagaaatggattgctgaagaaagctagagaattatcaattctttgtgatgctgaagttggattgatggtgttctccagcactgggaagctttatgactatgcaagcacaagcatgaaagcggttattgaacgctacaacaagctaaaagaggaaacccatcacctcatgaatccggcttcagaagagaagttttggcagacagaagcagcaagcttgaggcagcagcttcagtacttgcaagaatgccacaggcaattaatgggggaagaacttacgggtttgggtattaaagaactacaaaatctggaaaaccaactggagatgagtttaaagggtgtccgcatgaaaaaggatcaaattttaactaatgagattaaagaactacgccaaaagggaaatatcattcatcaagaaaatgttgaactctatcaaaagatggagcagatccaaaaagaaaatgcagagctacaaaagaaggtttatgaagcaaggagtacaaatgaagaaaatgtggcatccaatccttcttacaacgtcagaaatggatatgattcacttgcatctatcagtctccagctaagtcagccacagtctcaatacaaatacagtgaaccatcaaccaaagcaatgaaactcggattgcagctgcat

SEQ ID NO: 295 - DNA, 997 bp, Glycine max
ctgcgcgatgtgtttgctcataggtgggagggaggaaaacattttgtgtttggaaaggggtgtgtgcatatttccccttataccgcgccgaaggcacgcgtttttgccagagtcgcgagcgatcagctacgtaggccccccccccccttctagctccatcttccagttatcctttttcagttccataattttcaaatggggagaggaaagatcgtgattcgaaggattgacaattccactagccggcaagtgacgttttccaagagaagaaatgggttagtgaagaaagctagagagctatctattctgtgtgatgcagaagttggattgattgtgttctccagcactggcaagctttatgactatgcaagcaccagcatgaaatctgttattgagcgctataacaaggtcaaagaagaccatcaacagttaataaatcctgcatcagaagtcaagctttggcagagagaagtagcaagcttgcggcaacaagtgcagtacatgcaagaatgtcacaggcaaatgatgggccaagagctttctggattgggtatcgaagagttaggaaatctggaaaagcgactggagatgagtttaaagggtgttcgcatgaagaaggatcaaattctgattgatgaggtcaaagaactacaccaaaagggaagccttgctcatcaagaaaatgtagaacttaatagaaagataaatctcatccgcaaggaaaatgaagaactacaaaaggttattgaagctaagtgtagaaaaggtgttgcagcatccaatcctccattcactatcaactatggatgtaatatgcttgctcctatcagtctccagctaagcctgccagagtcaacgtagtaagccatcagccaaagcaatgaaattgggatattccctcaaactataactattgcctaggtctataaatatgtttaaggtccttattaatatactaaattttggttttagactatctaaaaaaaaaaaaaaaaaa

SEQ ID NO: 296 - DNA, 1248 bp, Glycine max
tcgatcagctacgtaggccccccccccacttcttttcttcttcttcaactcttccttaacagagcataattttctatgaaaggtgaatctggccattaattagtattcgatatctcagatatcgttgattaattgttattccaaaagaagagaagaaaatttggtgaaggaaaccctagtaagtagatggggagaggaaagattcccattcgaagaatcgaaaattcgacgaaccgacaagtgactttctgtaagagaagaaatgggttgctgaagaaaactagagaactatccattctctgtgatgcagaagttggagtgatagtgttttccagcactggcaagctttatgaatattcaaacaccagcatggaaacaatcattgagcgctttaacaagcaaaacaataatcatcatcggctaatggatgctacttcagcaatcaagggagaagcagcaagcttgaggcaacaactgcagcatttgcaagaaaaccacaggcaactgatgggtgaagaactttctggtttgggtattaatcagctaaaacatctggaaaatcaactacaaatgagtttgaataacgttcgcaataaaaaggatcacattttcagtgatgagatcaaggaattacaacaaaagggaagcttgattcgtcgacaaaatgaagaacttcataagaagatagaccttatccacaatgaaaatgcagaactaaagaaggttattgaagcaaggcataaggaagaagaaagggcagcactcaaacctccatgtgctatcaaaaatagatatgatacacttgaccctaacagtctgcaacaaaggcagtcccaaccccaacccagtgaaccatcagccgaagtgatgattatggggtactccctcaaattgaagatgtaaaaaatttaacgtgcatgtgatgtaatttaaattaaagtagaaatattttaaaaaaataagcgattattctctaaatataaactgcactaaacatgctttaagtctatagatttttatccttaattactttcgttataaagtaacaagccaagtgtgcagtgcactagattacagctgcattggtcaaaacctgttagatagcgatcgaacccatatatggagatgaatatgttcggtccatatgatttctaaatctgtactgtgtatcatgaatcatgaaacgaataatgcatcttaatgtacatctatatctatatattggccaataaaaaaaaaaaaaaaaaa

SEQ ID NO: 297 - DNA, 1041 bp, Glycine max
ggcacgaggaagattgttgatgatgtcttcgacaagattaataaagctgaagcaagtatatatgttgcggatcacccggttggattacacttagaagtggaaaaaataaggaaacttttggaggctggatctagtgatgctatctccatgatagggatccacggaatgggcggggtaggaaaatcaacacttgctcgagcagtttataatttgcatactgatcattttgatgattcgtgtttcctacaaaacgtgagagaagaatcaaacagacacgggttaaaacgcctacaaagcatccttctttcacaaatacttaagaaggaaatcaacttagcaagtgagcaacaaggcacttcgatgataaaaaataagctcaagggaaagaaggttctcttagttctagatgatgttgatgagcacaagcaattacaggcaattgttggaaaatctgtttggtctgagtctgagtttggcaccagattggttctgatcatcaccactcgggacaaacaactcctaacatcttatgtagctttgatgctttggaggaggagaaaaagtgtttttcagacattacttgttgcttgaaaggctataaatgcagagagattgaagatatacttcaacgtctttatgataactgcatgaaataccatattggggtgcttgttgacaagtctctcatacagattagtgacgatagagttacattgcatgacttgattgagaacatgggtaaagaaattgacagacagaaatcacctaaagagacagggaagcggaggagattatggttactaaaagatataattcaagtcttaaaagacaactcggggaccagtgaagttaaaatcatttgtcttgatttccccatatctgacaaacaagaaacaatagaatggaatggaaatgccttcaaggagatgaaaaaccttaaagcacttattatcagaaacggtattttatcccaaggtcccaattatataccagaaagtttgagaatattggaatggcacagacatccttcccattgtttac

SEQ ID NO: 298 - DNA, 1765 bp, Glycine max
tttttttcttttttatttgttgatgataaattgataatcaacatttgaaatgtaacttttcttgtatgtttcatgtgtgcatcaacaatatctcagtcaacacttcaaaacataaagaccattatagccctcaacaaaaaaggtcaaaataaggggattagaactaaaaaaatagtcagatacaagtactggagaaataaatttacaataacaatatttataatgtgaaaaatcaaaaaagttgtctggtgttttgaaactctagcgtgtgaatattggaagccagtatctctttaagaactgccagtaccggaatctgaacatctcaagtgctccacaaattcatcatataaaatctgatgagccttgatgtcatgccatgtgtctatggtttcaactaccaacttcagcaaattactaaatttaacctaatcattgcttgagtaactgtgtgtaaatcatttccaaataatgtcacccagaaatttgagagctggaacacctcttatctcaacatctatgagtggtgcctggatcatcaataagctggagagttctggatcgttctgaactatatcaagagcacgcatttgatcctttcttttcatagcacaaaacttgcaatcagatgtagatggtggaagaatctggttgacaataagtctcttcacaggaacattttccttcttcagggaagcactcaatctagatgactcactaattgccatcaccgtggggattgtaacaatgacaaattcggtcgaatcagtatcacgaaagagttcgcgcacttttatcatcctctctctgagtttctccaatttgtcagcagcattctgtcgggtttcttcttgcccaaacacggatttaattgctgaggtagcagaagctattttttgtcttagcttcagtatctttccaatggatgcatccaagaaatcgggtaaggacaataatcgtaatgtgtgacccgtaggtgctgtatcaaatactattcgagtaaacatgctatattcctgtgattcaagaaattgcataaccttggagatcgcaatagcttcatccagtccaggaggaggagaatccagtaattctcccagttttagttctcccaactggtctgcaatcattccaagacccatgccatccatgaagtctttgactccagttccaccatttttctgggcggcatttcgaaactcttccctagacttctcagggtttatttcaagagcaaaaagaggataatcaggtccttctactggcaccaatgcaccccctgtcaaatcctgagcaaaagaatcactcaaagaatgcgctggatcggtggaaaccacgagagtagggtgtccattattggcaaatttaacagcaagtgaagcagcacagcttgtcttccctactccccctttcccacctagcatgtaatacttcctcttagtcccagaaaccatctcatcaaaccccgatgcagcttctgtagtaccagcaattgatctcacttgaaaagacttagtgggggatttagtggaagcagaaaaggaaagaaaggtgacagctttggggagacgaagaagcagaggaggatttggtgcgaaggagaggacacccttgatggccatggagttcgttatgtgaagaaaagatgaaagaacagagccacatgccatttccgtactcctcctgctactcactttgcctttcgttttggtttactctatctctgtctctttcactcttcaccgctgcaaggtttttcttttca

SEQ ID NO: 299 - DNA, 654 bp, Glycine max
  misc_feature (566)..(566): n is a, c, g, or t
cacgcgtccgacaattcattgctgcttccgcggtgaagacacacgcaatagcttcactggttttctttttcaagctcttagtagaaaaggcaccattgatgcattcaaagatggtaaagatctcaagaaaggcgaatccatagcgccagagctgatccaagccattcaagggtctcgccttttcttcattgtggtgttttcaaacaactatgctttctcaactatccgaaaaaagctacaatatgcagagattgaagatcttgaaaagataacaaatatactgggtcacaaattttcaagtcttccaaatgatgatctggttgggatggaatcttgtgttaaagaattagcaaagcttttacgtttggggtccgttaatgacattcaagttgtggggatgagtgggataggtggaataggaaaaacaactcttggtcatggtttttatgtagaaatctctcattaatatgattttggttgtttcattgatgatgtaagcaaaattgatcagaattctagtgtatcaggtttacaaaaacaattaccttgtcaatctcagaatgaanaagtttagagatttaccatctatttaagggaacatgtttgttattgactaggctatgctagcaagggaattgatagttcttgataatg

SEQ ID NO: 300 - DNA, 1093 bp, Glycine max
atgtcctggcaacaagtattcttatcaaaaaaaagaaaaaacaaaaagacccagaaatctcatcatcaagttcttcccattgcagaagttgaaaagaaagttatggcagatagttcagtatcctttttattggacaagctgagttcgttacttgaagcagaagtgaaactacagagaggggtccgtgaagatgttcagcacatcaaatatgagctggaaggctacaagggcatcttgagggtggctgatgctctggaagacaaaaaccctgaactcaaagcatgggttaaacgagtaagagatgttgctcatgacatggaagatgctatagatgaattcagccttggccttgttgatcaacatggacaaggcaacaattcttcgtttcatatgaactttttcacccggcataagattgcttcaaatatacaaaatatcaaatccagagtggacattatctcccaggacgtccaaacatagctgggataggctcaggctcaagtcaacgattcatcaaggcttgatagccaaggagatgcacttctgctagaagaagctgatttggtgggtattgacaaacccaaaaagcagctcagtgacttgcttttcaatgaagaagcaggtagggctgtgattcccatttatgggatgggggggttggggaaaaccaccttggcaaaacaagtctatgatgatccaaaagtgaagaagcgtttcaggattcatgcttggattaatgtttctcagtcttttcaactagaagagctcctgaaagacctggttcaacagctccataatgtcattggcaaaccatctccggaagcagttggacaaatgaagagtgaccagctcaaagagttgatcaagaacttgcttcagcaaagcaggtatctcattgtgctggatgatgtgtggcatgtaaaggtatgggattctgtcaaacttgctttgcctaataacaaccgtggcagtagagtgatgcttaccacacgcaagaaagatatagctttgtattcctgtgctgaattgggtaaggattttgacctcgaattcttacccgaggaagaagctggtatcttttctgcaagaaaac

SEQ ID NO: 301 - DNA, 2188 bp, Glycine max
aaaaaaagcagcatgtggggaacaaaagtaaagagactcccaaaaagcatccaggccaacgtgataagtcagccaccaccaccataataaataaaaaaaccgttcatagcaaccaattccttgcctttgtctttctactctgatcatcttttgttcttgagataatggcagcagcactggtaggtggtgcctttctctctgctttccttgatgtggttttcgacaggctggcttcacctgattttgttcacttgatccttggaaagaagcttagcaagaagttgcttcaaaagttggagaccactctcagagtggttggagctgtgcttcatgatgccgagaagaaacagatcacaaacaccaatgtcaaacactggctcaatgatctcaaagatgctgtctatgaggccgatgacttactcgaccatgttttcaccaaagctgccacccaaaacaaggtaagaaactttttttctcgcttttccgataggaagatcgttagtaagttggaggacatagttgtcacacttgagtctcatttaaaactcaaggagagtcttgatttgaaagagagtgcagtggagaacttgtcatggaaagctccatcaacatctgtggaagatggatctcatatatatggtagggaggaagataaggaggccataatcaagttgttgtcggaggataacagtgacggtagtgaagtgtccgtggttcctattgtgggcatgggtggggttggaaaaacaactttggcccaattggtgtacaatgatgagaatttgaaacagatatttgactttaaggcatgggtttgtgtttctcaagaatttgatattctgaaggtcacaaaaactataacagaggcggttactggaaagccttgtatattgaatgatctgaatctacttcatcttgaattgatggacaagctgaaagataaaaaattcttaattgtcttggatgatgtttggacagagaattatgttaactggagacttcggggggggcccttcgtccctgggattaggagaagtaagattcttctaacaacccgcagtgaaaaaacagcctctgtagtccaaactgttcacacctatcatctaaaccaattgtcgaatgaagattgttggtcagtgtttgcgaaccatgcgtgtctttcctccgaaccgaacgagaacacagaaatactagaaaaaattggaaaggagattgttaaaaagtgcaacggactgcctttagcagcacagtcgcttggaggcatgttgagaagaaagcatgacatcagggattggaataatattctgaatagtgacatttgggaactttctgaaagtgagtgtaaagttattccagcactgagacttagttatcattatctccctccacatttaaaacggtgctttgtttattgttcgttgtatccacaagattaccaatttgaaaaaaatgaattaatcttgttgtggatggctgaagatcttttgaggaaaccaagaaaaggtgggactttagaagaggttggtcaggagtattttgatgatttggttttgggatcatttttccaacgttcaaatacaagtagttggcctcatcgcaaatgttttgtgatgcatgacctcatgcatgatctagccacatcactcggtggagatttttattttagatcagaagaacttgggaaagaaacaaagatcaataccaagactcgtcatttgtcatttgccaaattcaattcttcagtcttggacaactttgatgttgttggtagagcaaaatttctgagaaccttcttgtccattatcaattttgaagctgctccattcaacaatgaggaggcacaatgtatcataatgtcgaagcttatgtacttgagagttttatcatttcgtgacttccaaagtctggattctttgcctgattcaataggtaaattgatccatctgcgctatttagatctctcttgttcaagtgtagaaacactgccaaagtcattgtgtaatttgtacaatctgcaaactttgaagttgtctcattgcagaaaactgactaagttgcccagtgacatgcgcaatcttgttaacttgcgtcatcttgagatacgtggaactcgtataaaagagatgccgagaggaatgggtaaattaaatcatttacaacatctggatttccttgttgtgggcaagca

SEQ ID NO: 302 - DNA, 515 bp, Glycine max
gtggtaatttggttgggatggaatcccgtgttgaagaattagaaaagtgtttagcattggagtcggtcactgacgttcaagttgtcggaattagtggaatggggggaataggaaaaacgactcttgcccttgctttatacgaaaagattgcttatcaatatgatgttcattgttttgttgatgatgtaaacaaaatttatcaacattatggttcattaggtgtacaaaaacaattacttgatcagtgtctaaatgatgaaaatctagagatttgtaatgtttctaggggaacatatttgatagggactaggctacgcaataaacgaggacttatagttcttgatgatgttaatcaggttgaactactacacatgtttacagggagtagagagactctattacgtgagtgcctaagtggagggagcaggatcatcataatttctagggatgaacacatattaaggacacatggagttaatatgtttcagagtcaggccattgaataagacaatgct

SEQ ID NO: 303 - DNA, 1693 bp, Glycine max
gcaaacacttgttcttcttccttcacagttttgcaattgaaatggcttctacttctaatgccatcatccaatgcacctcttcttcttcttcgtttgagtatgacgtgtttgtgagcttccgcggtgaagacacacgaaacagcttcacaggttttctttttgaagctctgaaaaaacaaggcatcgaggccttcaaagatgataaagatatcaggaaaggcgaatccatagcaccagagctaatacgagccattgaagggtctcatgttttccttgttgtcttttccaaggactatgcttcctcaacttggtgcctgcgtgaactagcacatatctggaattgcattcgaacatcttccagacttcttctgcctattttctatgatgttgatccatcacaagtgcgaaaacagagtggagactatgagaaagccttttcccaacaccaacaaagttccaggttccaagagaaggaaattaaaacatggagagaagttctgaaccatgtaggcaatctctctggttgggatatcagaaataagcaacaacatgcagtgattgaagaaattggtcagcagataaaaactatcttgggttgcaaattttctactcttccatatgataatctaattgggatggaatctcattttgctacattatcaaagctaatatgtctggggccggttaatgatgttccagttgttggaattactgggatgggtggaataggaaaatctactcttggtcgatctttatatgaaagaatctctcatcgatttaattcttgttgttatattgatgacgtaagcaaactttatcgacttgaaggtacattaggtgtacaaaagcaactactttctcaatctctaaatgaaagaaatctagagatttgtaatgtatgtgatggaacacttctggcatggaagaggttacccaatgcaaaggcacttatagttcttgacaatgttgatcaagataaacagcttgatatgtttactgggggtagaaatgatctgttacgtaaatgcctaggtaaagggagcatagtcattataatttctagagatcaacaaatattgaaggcacatggagtagatgttatttaccaagtggagccattgaatgacaatgatgctcttcaattgttttgcaaaaaagcatttaaaaataattatattatgagtgattttgaaaagttgacttctgatgtactatcacattgtcaaggtcatcccttagcaattgaagtaataggctcatatttgtttgataaagatttctttcattggaggagtgcattggtttcgttaagagaaaataaaagtaaaagtattatgaatgtgttgcgaataagttttgatcaattagaggatacacacaaggaaatatttctagatattgcatgtttcttcaacgatgatgatgtggaatatgtgaaggaagttctagattttcgtggatttaatcccgaatatgacctacaagttctcgttgataaatcacttataaccatggatgaggaaattggaatgcatgacttgttgtgcgatttgggaaagtatattgttagagaaaaatcacctaggaagccatggaagtggagcaggttgtgggatattaaagattttcacaaagttatgtcagataataaggtagaataatttataaatataaagtcctcctattattctag

SEQ ID NO: 304 - DNA, 2187 bp, Glycine max
  misc_feature (1933)..(1945): n is a, c, g, or t
  misc_feature (1948)..(1957): n is a, c, g, or t
  misc_feature (1962)..(1964): n is a, c, g, or t
  misc_feature (1967)..(1978): n is a, c, g, or t
  misc_feature (2078)..(2080): n is a, c, g, or t
  misc_feature (2109)..(2109): n is a, c, g, or t
  misc_feature (2127)..(2129): n is a, c, g, or t
cgattgggtaccgggccccccctcgagtcagctacgtaggcccccccgactattcaattatcttcaggaagcaggtttagtttccaccttctgcaatggcttgtattagaatccaaagaggctcttcatcacacacgaagaattttgatgtgtttgtgagctttagaggtctggatactcgtaatagtttcactgatcatctttttgctgctcttcaaaggaaaggcatttttgctttcagggataaccaaaatatcaacaaaggggaactcttggagcctgagctcttgcaggcaatcgaaggatcacatgttttcattgttgtcttctcaaaagactatgcatcatccacatggtgcttgaaagagctgagaaagatttttgatggggttgaagaaacagggcgaagtgtactccctattttctatgatgtcactccttctgaggtccggaaacagagtggaaagtttggaaaagcttttgctgaacacgaagaaaggttcaaagatgaattggaaatggtaaaaaaatggagggaagctctcaaagcaattggcaatcgtagtggttgggatgtacaaaataagccagaacatgaagaaattgaaaaaattgttgaagaagtaatgaacctactgggtcataatcaaattcatagtcaaatttggagtttctctggtgatttagttgatatggactctcgtgtgaaacaattggaagagcttctagatttgagcacaaatgatgttgttcgcgttgtgggaatttgggggatgagtggagtaggaaagacgacacttgttactgctttgtttggtaaaatctctcctcaatatgatgctcgttgttttattgatgatttaaacaaaaaatgtgggaattttggagcaataagtgcacaaaaacaacttctttctctagctctacatcaaggaaatatggagatacacaatctttcccacggaaccatgttgataagaactaggctatgtcacttaaagacacttattgttctggataatgttgatcaggttgaacaattagagaatttggctttgcatcgtgaatatttaggtgaagggagtagaaccatcataatctctacaaatatgcatatcttaagaaattatggagtagatggagtttacaatgttcaactccttaataaggataaggctcttcaattactttgcaaaaaagctttcaaatctgatgatattgtgaaagggtatgaagaggtaacacatgatgtactgaagtatgtcaatggccttccactagcaatcaaagtattgggctcatttttgtttgatcgacatgtttttgagtggagaagtgcattaactagaatgaaagaaaatccaagtaaagatatcatggatgtgttgcgaataagttttgatggattggagacaatggaaaaagaaatatttttagatattgcttgtttcttttcaagtgatcaattccggggttatgacgggtggtttgaaacttctaagaaaattctaggctatcgaggattttatcccgaaattggtatgaaggttcttgttgaaaaatcactcataagttatcatagggggaaaatttgtatgcatgacttgttgaaagagttgggcaagactattgttcgagaaaagacacccaaggaacctagaaagtggagtaggttatgggactacaaggatctccaaaaagttatgatagaaaataaggaagccaaaaatcttgaagcgatagttattgatattgaaaaatatcaagaagagtttctacaacgaacaatgacagtagatgctctatcaaaactgattcatcttaaattactcatgtttaagaatgtgaatttttcaggaatcctcaattatctttctaatgaaatgacgtatttatattggaaaaaaaaaaaaaaaaaagaattcctgcagcnnnnnnnnnnnnnggnnnnnnnnnnggggnnnggnnnnnnnnnnnnttaaagggcgccccccccccgcggggggggacccccccccctttttttcctccttttttggggggggggtatatttctccccggcgggggggagaaaaannnggtggaacacccccctcttcctctccctnaaaaaaaaaaaaataggnnncccccccccccaattccccccaccaaaaaaataaaaagagggggggggggggacagag

SEQ ID NO: 305 - DNA, 3760 bp, Glycine max
  misc_feature (569)..(569): n is a, c, g, or t
ggttcccttaggtgatgatttgccattctttgttttctttaaacttttaggcaacaacatgcagtgattgaagaaattgttcagcagataaaaactatcttgggttgcaaattttctactcttccatatgataatctagttgggatggaatctcattttgctacattatcaaagctaatatgtctggggccggttaatgatgttccagttgttggaattactgggatgggtggaataggaaaatctactcttggtcgatctttatatgaaagaatctctcatcgatttaattcttgttgttatattgatgacgtaggcaaactttatcgacttgaaggtacattaggtgtacaaaagcaactactttctcaatctctaaatgaaaaaaatctaaagatttgcaatgtatctaatggaacacttctggtatgggagaggctatccaatgcaaaggcacttataattcttgacaatgttgatcaagataaacagcttgatatgtttacagggggtagaaatgatctgttaggtaaatgcctaggtaaagggagcatagtcattataatttntagggatcaacaaatattgaaggcacatggagcagatcttatttaccaagtgaagccattggatgacaccgatgctcttcgattgttttgcaaaaatgcatttaaaaataattatattatgagtgattttaaaacgttgacttctcatgtactatcacattgtgaaggtcatcccttagcaattgaagtattgggctcatctttgtttggtaaagatgtctcttattgggggagtgcattggtttccttaagagaaagtaaaagtattatggatgtgttgcgaataagttttgatcaattggaggatacacacaaggaaatatttctagatattgcatgtttcttgtacgatcatgatgtgatatatgtgaaggaaattctagattttcgtggatttaatcccgaatacggcctacaagttctcgttgataaatcacttataaccatgcgtaggatagttgaaatgcatgacgttttgcgcaatttgggcaagtatattgttagagaaaaatcaccttggaatccatggaagtggagtaggttgtgggatttcaaagatctcaacatagtttcgttggataataaggtaaaataatttttaaatataaagtcctactattattctagaatttgtaaatacttttaaatatctaatattttctttcctcttttcaatgttcaaggcaacagaaaatgttgaggccatagttcatgaagaagactatgacattgaaaagactctgacttagaagaagactctaacttagaagactctgacttagaagaagactctgacttagaagaagactctgacttagaagactatgacttagaagaagactctgacttagaagaagactctgacttagaagactatgacttagaagaagactctgacttagaagactctcactttcttccaacagtgagggtggatgctctatcaacaatgagtaaccttaaacttctcaaatttagatacgctggctacgaaatcaattattcaggaacacttactaagctttccaatgaattaggatatcttacttgggtaaagtatccttttgagtgtttgccaccaagttttgagccggacaaacttgttgagttgattctacctaaaagcaacatcaaacaactttgggaagatagaaaggtaatatcaattattattattattatttttctatattgttttcatttaaataaacaaataaaaaggcaaactttcttaagataatccttttttctctatttaattaaagaaacaaaagaaaggctgaatgtcattattaattttgtttcctactattggtcttgtattgtagcctctacccaatttgaggcatttggatctctctggctccaaaaatctaataaaaatgccatatattggagatgccctatatcttgagtggcttgatctcgaaggatgtatacaactcgaagagatcggtctgtccgttctttcacgaaagcttacttctctgaatttgagaaattgcaaaagtcttatcaagttgccacagtttggagaggacctaattcttaaaaagctatatctcgaaggatgtcaaagtctcagtcacattgatcaatccatcggttttctaaaaaaacctcgatcatttgaatatggaaaactgcaaacaactcaaacgcattgatccatccatcggtttactagaaaagctcagagaattgaatttgaaaaactgcaaaaatctagaaagcttacccaatagcatactaggtctcaattctcttaaatatctgaatctctctggctgtgtaaaactgtacaacaccgagttattatatgaactaagggatgcagggcaattgaagaagattggtatagatggagctcctattcatttccaatcaacatcttcctactccagacaacataaaaaatcagttagttgctcaatgccttcctccccaatatttccatgtatgcgtcaacttgatctaagtttctgtaatttagttgaaatccctgatgctattggaaatatgtgttgcttagaatggctagatttaagtggtaacaattttgctacactgcccaacctcaagaagctttccaaactgttgtgtttaaagttacaacattgcaagcagttgaaatctttgcctgagctcccttcacggattgaaatcccaactggtgaaagctattttggaaacaaaacaggattatacatttttaattgcccaaaattatttgataggaaacgctgcagtaacatggctttttcgtggatgatgcaattgtatcaggtgatccattctttttacagatctgaaggtgttagtcctggaagtgaaataccaaagtggttcaataatgagcatgagggaaattgtgtaagcttagacgcatctcatgttatgcatgacgataattggattggcgttgcgttttgtgcaatattcgtcgtacctcatgaaacaatctcagcgatggctttttcaaaaacagatgggtactactcgggttttagtgatattccagtggatttttatgaagatctagatcaagaacttgttttagacaaatcagatcacatgtggctattcttttttgatcgaaaaatgttcatttttaaattccatctccagcccgaaaatcttggaagattgcttttgaaatgtgatggaaggagaaagtggaaagagtcatatgctgaggtgaagaaatacggatatcgctgggtatataaaggggataatgaacaaaggaagcgcaaatttggggaaattgaagaaaatgaaggaatgatgtcagaagaagggagaaaagatgatgcaagctcctcccaggaaaacacaatcaacttggatcttagcctgtagaatcatttcttctctcattttattcatttcagtcgtccttcaaattttgaataagcttggtggcgtaaaataaggtttttggttgttatgggatgcttgtgtagctgtctttgttggttaagaatattgtttttttttttttttttttcttgtttggtttgagtaatgtttaacagagactgatgcaatttctcgttttcagtcctttttacttttagtgcatgacagctaaaaaaaagtacaaataatttttttttaaaattctcgtgtcagtcgatccaggaatcaggaagtcaaactaaggaataaaaaatttaaatttattaatc

SEQ ID NO: 306 - DNA, 2327 bp, Glycine max
ctcaataatcacttttatcatttcaaacaaagaaagttgttagtgcttaacattcctttgaatattaaactaagttcaatttttatttcttaccattagcgtgacatgaaaaaataaatttattaattccaatatatattggtggtataaagcacttccatatatgattggtcacaatttttttttacttagattccatcttcattgaaaaaagttaaaacacatgaaaaattaattatttcagttaaattaattcctttcactttttaaatatattctttatttgggtaaaataattcctttttgttatgtgtgagtttgaaattcttttaatttaatatatttgtaaataaattattttgacctaatatattgtaaatcaattcaaaaatagaatttactgtctaaagactcattattcaaccaaacgagagagttgtgttattctatagtgacggagcaacagaaaggttaagaatgtagcataaccaaaacaatgaaacaggtgatgtagaagatcatgctgtgaacggaggtagcaatggcgatgatgctttgactataaataatttgctatccgatctagcaaggcaagaagactactttgataaagaattacagtgggcgggagttccaggccattaagcgtaagagacaagatgacgattggtcggataaactaaaggacctgaaaaaaagagttattgatgtgaaaaactcactgcatcagtctgggtcgactaatgaaatgcccaagccttctgaattgcatgctaagtttatttatttattgatagagaagctttgggagttgcgagatgaaaatgtgaagaagatgtgggatcttctggaggatgaggaagtcttcattattggcatagatggaatggggggagttggaaaaacattcatggcaactcatttcaagaatgagattaaaagaaaggggactttcaaggatgtcttctgggtcactgtttcccatgatttcaccattttcaaattgcaacatcacattgcagaaacaatgcaggttaagctttacggagatgagatgactagagcaacaattttgacgtcagagttggagaaaagagaaaaagcactgcttattttggatgatgtttgggaatatattgatctgcaaaaggtggggattcctcttaaagtgaatggcattaaattgattatcacaactcgtttgaaacatgtgtgtctacagatggattgccaaccatataatataataacaatattcccctttgaagaagaagaagaagaagaagaagaagaaaaagaagaagaagaagaagcttgggagttatttttgctaaaacttggacaccgtggaacacctgcaagacttccccctcatgtactagagattgcaagatctgttgtaatgaaatgtgatggtttaccacttggaatcagtgtgatggctcgaaccatgaaagggaaaaatgagatccattggtggagacatgcattgaataaacttgacagattggaaatgggagaagaggtcttaagcgtactaaaacgtagctatgacaatttaattgaaaaggacatccaaaaatgtttcttacggtctgcactgtttcctacaattattaggaaagaggaatgggttacgatggttgttgagagtgggttgttaaatggaaagaggagtttggaggaaacatttgatgagggacgcgtcataatggataaactcattaaccattctttgttgttagatcgtgggagtttacgaatgcatggtctggtgaggaagatggcgtgccatatcttgaacgagaatcacacttacatgataaaatgtgatgaaaatttgagaaagatacctcaratgcgggaatggacagctgatctggaggcagtttctttggcgggtaatgagatagaagaaatagcagagggcacatcacctaattgtccaggcttgtccaccttgattttatctcataatttgatcagtcatattcccaagtgttttttcagacacatgaatgctctaacactacttgatttatcatataattatgagttaacatctttgccaaagtctctgtctaagttgaggtctcttacttctttagtgctccgtcaatgttcaaaattgaaagatatacctccactgggagatctacaagcattgtcaagattggacatttcaggttgtgattcgctcctcagggtaccggaaggcttgcaaaatctaaaaaagttgcaatgccttaatctttcccgcgatttgtatttatcattggtacccggatgcgcacttgccggtttgagcaatatgcaatatctggatc

SEQ ID NO: 307 - DNA, 1321 bp, Glycine max
tcagctacgtaggcccccccggccagttctgaagagaaaatctcccttctttcactagtaaaattttcagatattcaaatagatcccgttgctgcattcagtaatcacaaccacctggaacgccattattcaattcaattggaaataaatcatgggtcgacctagaggtgatgaaaagtactggaatgaagtaacgagttttgaagagaacgggaagcagaagtggaagtgcaagcattgtgaaaaaacgtatggtggaggttattcaagaattaaactgcatttagataaagaacaaaaaggacaaggcattactaaatgccccgtttattgtagcaatgaagaagttctcaacatcattgcttccacttcaatccatccacaagaaactgtaaatacactgaatccattacaagtggttgaagatgttgttgctggcgaaatgattgtccctgttggtgctccaattaaccatcaaacaaataatgaatcaacaagtttattcgaaggttgggcaccagagcatgctattgtcggaagcaacaattcgaatggtattttccaaagtaagattagtgtgataaatgagttggtttccgatctatcaagagaggaagatgacatcaaggaacaattagaatggctagaatctcgcggcaagaagcgcaagggtgatgttgatgactggatggatgaactacgagacctgaagaaacatgttgctgatgtggattggttagggttcactaacttttatgcatcggatttggttgataaattgcgaaagcataagattgataagcctctggtgttgtcaaatgaatttgttggtgaacaatttgagttaaatgttggaaagatgtggaagcttctggtggatgaccaagttttcgttattggcataaatggaatggggggagtggggaaaacattcctagcaacttatatggagaatgagataaaaagaaagggaagtttcaggcatgtcttctgggtcactgtttctcatgatttcaccactttcaaattgcaacatcagattgcaaaaaaaataggggtaaaacttgatggagatgatgagagatgtagagcaacaattttgtcatcggagttggagaaaatagaaaattcagtacttattttggatgatgtttggagatatattgatctacaaaaggtgggaattcctcttaaagtaaatggcaaagtaaatggcattaagttgatcatgacaagtcgtttgaaacatgtgtgtcgacagatggattgcctaccagataatacaatacaaatataccctttgaaaaaaaaaaaaaaaaaa

SEQ ID NO: 308 - DNA, 532 bp, Glycine max
aattcggcaccaggagcctgatattaggacttgcaatttcttgctgaaatgcttggttgaggcgaatagagtggagtttgttagacgggtttttgaggaattgaaggaccgtggtccatcgccaaatatctacacttatacaatcatgatgaatttttattgtagtgatgttgggtgtgatgcaggtatgagacaggctgctgtgattctgggaaaaatatatcggagtggggaaaagccaactgttgtcacatatagtacttatattcatggactttgtaaagttggtaatgttgaggctgctctgatgttaattcgcaacttgcactatacaaaccagcccctcaatagccattcttttaatgatggaatttatggattttgtaaaagaggtgaagtgtttgaggctttgcaagttttggaagaaatgaagagctctgggatattaccagatgtttatagctacagcatcttaattaatgccttctgcgggaaaggtgatgtaatgaaatgtcttgacttgatggaggaa

SEQ ID NO: 309 - DNA, 543 bp, Glycine max
tggccttattcactcgcttgattactatgcaccctcttccatctgttgtagaatttaacatgattttagggtcaatagtgaagatgaagcattacccaactgctatatcactttctaaacaaatggggttgagaggaatcacaccgtccatagtgactttgagtatcttgatcaattgttactgccacttgggtcacatgggttttgctttttctgtgttgggcatggttctcaagaggggatatcagctcaatgccataaccttgaccacaatcatgaaagggctttgtatcaatggtgaggttaggaaagcattggaatttcatgacagtgtggtggcacaggggtttctgttggatgaagttacttacgggaccttgatcaatgggttgtgtaagataggactgacaagagaggcctttgagttgctgcacaagatggaagggcaagtggttaggccgaatgtagtaatctacaacatgattgttgatggtttgtgcaaagatggacttgtaactgaggcgagggatttatattcggatg

SEQ ID NO: 310 - DNA, 646 bp, Glycine max
tatgtttgggatctttttgatgagatgcttgatagaggtcaacctcctgatgtaatcacctataataacttgatagatgctttatgcaaaaacggtcatcttgacagggcaattgcattgttcaacaaaatgaaagatcagggaattcgaccgaatacattcacattcactatacttcttgatggactatgtaaaggtggaagacttaaggatgcacaagaggtttttcaagatcttttgactaaaggatatcatctcaatatctacacatacaatgttatgatcaatggacattgtaaacagggcctgctcgaggaagcattgaccatgctgtcaaaaatggaagacaatggttgcatccctaatgctgttacttttgacattatcatcattgctctctttaaaaaagatgagaatgataaggcagagaaacttcttcgacaaatgattgctagaggcttgttgtaagactaaaactatgtgagatgtttctagtgactcactatgttattttgaatttggtgatgttatttatttcttttgtttaaaataatcaatgtaatgggctcactatgcctttacttttgattaaaagtcatatgtacttagctgcattttttttatgttataaatataccaatagccc

SEQ ID NO: 311 - DNA, 457 bp, Glycine max
gattcctgatattgtgacttatacctctcttattgatggtctgtgcaaaaatcatcatctggagagggcaattgcattatgcaagaaaatgaaagagcagggaattcagccaaatgtatactcatacacaatacttcttgatgcactgtgcaagggtggaagacttgagaatgcaaagcagtttttccagcatcttttggttaaaggctatcatctgaatgttcggacatataatgttatgatcaatgggctttgtaaagcgggcctgtttggtgatgtgatggatttgaagtcaaaaatggaaggcaaaggttgcatgcccaatgctataacttttaaaacaattatttgtgccctacttgaaaaagatgaaaatgataaggcagagaaattcctccgagaaatgattgctagaggcctactgaaagtgtaaaactagatgcgatggtttccaatt

SEQ ID NO: 312 - DNA, 2130 bp, Glycine max
cggacgcgtggggctgtgcctactgtggtgacctacaatacgattatgtatggcctttgcaagtgggggagagtgagtgatgctaggaagttgcttgatgttatggtgaataagaatctgatgccggatttggtttcgtataacactctgatttatggttacaccagattgggaaacataggggaggcttttctcttgtttgccgagttaagatacagaagtcttgctcccagtgttgtgacctataatacacttatcgacggtctttgcagattgggggacttggatgttgccatgcggctaaaagatgaaatgatcaaacatgggcctgatcctgatgtatttacttttacgacttttgttagaggattttgcaagatggggaacttgccaatggctaaggaattatttgatgagatgcttaatagaggattgcagccagatcgttttgcgtacataacccgaatagtaggtgagctgaagcttggcgacccatctaaggcttttggtatgcaagaagaaatgctagccagaggctttcctcctgatttgatcacttataatgtcttcattgatggtctccacaagttgggcaatttgaaagaagcaagtgaacttgtgaagaaaatgctctacgatggacttgttccagatcatgtaacatatactagcatcatccatgctcacttgatggctgggcatcttaggaaggctagagcattgttccttgagatgttgagcaaagggatatttccttcagttgtcacttacactgttcttattcattcatatgcagttaggggaaggctgaaacttgctattttgcacttttttgagatgcatgagaagggtgtacatccaaatgtgatcacctacaatgctttaatcaatggactttgcaaggtgagaaagatggatcaggcatacaatttttttgcagaaatgcaagcaaagggcatttctccaaataagtatacttacactattttaataaatgagaactgcaacctgggccattggcaggaagctttgaggttgtataaggatatgctagatagagaaattcagcctgattcatgcacacatcgttctctattgaagcatctaaacaaagactataaattgcatgtagttcggcatcttgagaatgttattgcagctggtgaataaatttatgatgtaaggatgaagaatggttatttattattatcattttggctttctcacatggctgatgagtaaaagaaaaccctatatttgaatgggttttgccttttgaggtgtaaattcccccagacagaatcttgtatatttttctgactgtcacggttgaagatgcctgtggtgttcttgatgattaagatggacagacttcaactattaacaagttttcactcgttatatccctagactagtcaggggaaccaatttgctttgtggctatttaagcagtgtgtaactgctaatttttcttcagctgttatttgacttctgacatagatactggacctgcatagttggtggtcaattcaaatacagaagccaaacaatcagaaaagatttaatcataattgattcctgatgcattgaagtatatagattctgatgatatgaaaaagatcaaaaatcagttcccaccattcgttaaattcaaaatggtcctttaataatgttatggacaggtcaaagtaggcagatttgatgttccatgatcatgaggtcaattatgggaacctcatgtatggactgatgaaggagtatatccaacataactgaaaggtcctgtctgagtcctatgaatttttccatgagcatcatcttcatcaagagataaaaaataaataacagattgtccttcaggcatcaccaacagggtagatggcaagcaagaattggccaagttgcaggaaacaaggatctatactttgatatgcatcatttcaaccagtggtcttctaacttgaaggagcagctgtcttaggggggttatgtctctgttgtttttgcttttgtgtctatctttatgttgggttaggcaacttgccttgtatatttgtatcctatttccagtacacctagtactgagttatatataataatatctgatttttgctgtgcaaaaaaaaaaaa

SEQ ID NO: 313 - DNA, 547 bp, Glycine max
ctctttggaaagttataacttatggttgttgggtttgcttgggaatggagagctgttggaggctcgattggttcttgatgaaatggcggctaaagacattgagccgaatgcttacacatataacattatggtggatgggctgtgcaggaaccatatgttgtcggatgcatgagggttgatggatctgatgatgaagaatggggtttaccctgatacggttacttatagtaccctcctgcatggatactgcagcagagggaaggtttttgaagctaaaagtgttcttcgtgaaatgataaggaatgattgtcagcctaatacttacacttgcaacacattgctggatagcttgtggaaagaggggaggaccctagaggcagaggaaatgctgcaaaagatgaatgaaaaatgctatcaaccggatacagtgatctgcaatattgtagtcaatggtctctgtagaaatggagaactaaacaaagcaaggtttttaatttgcctgatggaatcacatagacaacttcaattaatggactttgcaaagttg

SEQ ID NO: 314 - DNA, 621 bp, Glycine max
  misc_feature (568)..(568): n is a, c, g, or t
  misc_feature (600)..(600): n is a, c, g, or t
tcagctacgtaggcccccccccccccgcaaatgtaatcacctacaattccttaatagatggtttatgcaaaaatggtcatcttgacaaggcaattgcattattcatcaaaataaaagataagggaattcgactgaatatgttcacattcaatatactttttgatggactatgtaaaggtggaagacttaaggatgcacaagaggttcttcaagaacttttggataaaggctatcatgtagatatctacacatataatgttatgatcaatgggctttgtaaacaggacctgcttgatgaagcattggccatgctgtcaaaaatggaagacaatggatgcaaggctaatgcagtaacttttgaaattatcatcagtgctctctttgaaaaagatgagaatgataaggcmgaaaaacttcttcatgaaatgattgctagaggcttgttgtaagactaaactacgcgagaactatctagttacacgtgaaaaagaagatgaacaatgcaatgggctcaatatcactttacttwwgattaaaggtgatatgtacttagcttcattttttatgntataaatataacaatagtcaaatgattattgncttgatttaaaaaaaaaaaaa

SEQ ID NO: 315 - DNA, 684 bp, Glycine max
ggagaaatgctgcataaaaatagacccacgcgtccggtgacgtacaattctcttattgatgggttgtgcaaatcagggaaaattacttctgctttggatcttatgaatgagatgcaccacagaggtcaaccagctgatgtagtcacctacacttccttattagatggtttatgcaaaaaccaaaaccttgacaaggcaactgcactattcatgaaaatgaaggaacggggaattcagccaactatgtacacatacacggcacttattgatggattatgtaaaggtggaagacttaagaatgcacaagagctttttcaacatctcttggttaaaggctgttgtatagatgtctggacatatactgtcatgatcagtgggctttgtaaagagggcatgtttgatgaagctttggccattaagtcaaaaatggaagacaatggttgcatccctaatgctgtaacttttgaaatcattatttgttctctttttgagaaggatgaaaatgataaggccgagaaacttctccatgaaatgattgctaaaggcctattaggttttaggaattttcatggggagtgatctccagatacaaattaagttattgttaattttcatggtgagcgaccaatgtttattgcgtttgattgtttgatagactacgctatggacatttcatttgattat

SEQ ID NO: 316 - DNA, 932 bp, Glycine max
  misc_feature (36)..(36): n is a, c, g, or t
aaatggataagaataactttaaacccgtcaccactntgaataactcgctctccgttttttatcgcgacgggaaagtgttgaaagagtttgtgtaagctgaagaggtcttcggaggcaaaggcgttgctcggggggatggtttgtaatgggaggaagccgaattcggttagctacgcttgcttgatccatgggttttgtaaagagggggaccttgaggctgttcaagtacatgaagaggagagggtacttgcccgagggggagtgttattttacgctcgtgcattttctgtgtcgcggtggtgagtttgaggccgcattggatgttgctaaggagtgtatggggaaaggttgggtgccgaattttactaccatgaagagtctcgtgaatgggctcgctggtgcattgaaggtggatgaggcgaaggaggttattaagcagattaaggagaagtttgctgagagtggggataagtgggatgagattgaagctgggttgcctcagtgagaaagagtgtggtctcctttgtattgtacaattctttgatcaattggaggggagcactgaaaattgaattaactatggaatatcagctttggaatagctttattttgttttgccatttcttctagccattggcctttttgcttgctcgaatgaattcatcggtgactggtaattttgccaggttagtttaacatgttcgctgttgttaggcatgctttgttttccttgattgagtaataaatagatttggaaatggttttgcagccagttttctgtttgtttccatctgttttgcctctttaaaattgtattaccccctttttttccgaagggagaatgatcatacactgcatgggagctcttatggacctgtatatttcatttctgtattaatttattactttctggtttggtttcttggtctgct

SEQ ID NO: 317 - DNA, 870 bp, Glycine max
attcaaagggcatttggtctctgctcttgaattcttctatgatatggtagcaaaaggctttgagccaaatgtgatcacatacacaatattgataaatggtttctgcaagcaagggcgattagaggaagctgctgaaattgtgaatagcatgtcagccaagggtctgagtctgaatacagtacggtacaattgtttgatttgtgcactgtgcaaggatgggaagattgaagaagctttacagatttttggtgaaatgtcaagcaaaggatgtaaacctgacctttatgcatttaattctttaataaatggactttgcaagaatgataagatggaagaggccttgagtttatatcatgacatgttcttggagggtgttattgccaacactgtaacatacaacacgttggttcatgcatttcttatgagagattcagttcaacaagcatttaagctttgtggattttggttgaagtgctattttgagttatatcatcaatatggtcgaagttttctgtagttcaagcataaacattcattttttatgtatatatcagtagagagaaagataggtgtggctgattccactgctcgttaagaggtaaccaactattgccatgccatgtcgaactgtctcccctcagattgattgatatgattttttttgtttttaaaaactatgacatgtttgttgtttgtcctttgattattattattcaatttatttatctccttctctggttacttggttggattgatatgattgtgaaactgagcttttagacataatggtggctttggttttagctttgtttttgttttttgttttctgtatttgtagcttgtgcttatgttgcaattggtttgagctcc

SEQ ID NO: 318 - DNA, 822 bp, Glycine max
gaggagagagagagagagcacacaaaatggtttccaaagagcaaaagagagcagcactgcatgagaagctgcaacatcttcgttctattactaactctcgtgctctaaataaaacttcgatcatagtcgatgcatcaaagtatatcgaaaagttaaagcaaaaggtagaaagactgaatcaagagatagcctctgcagaaacttcaagtgtccacaaccctttgcctatggttacagtagaaaccctagaaaagggatttcttataaatgttttctcggcaaaagggtgttcaggtctgcttgtttccatattggaggcctttgaagagatgagactcactgtgcttgaagctagggtttcttgtacagacacttttcgatttcaagcagttggagaaaatgaagaacaagtggagacaattgatgcacatgttgtgaaacaagctgtggtacaagcaataaagaattggagcaaaagtggcgatcaagaagagtaaatcagtaatcaaatgtttgctatatatattgcaattttccaatttttttttcccattttctttcatgttggctaactggtaaattgttccttgaggaatcaggcgtcgtacaagatagcttccaatttttaatgaaaatatatatgtgccagctgtaagagaatgataaaaagtagttgatggttgataaaatttatgtatggagccagcatttacatatgtaatatatacccacatatatacatataatgatgcataaaccaatgcatatataatgcattttaattattttatataaaaaaaaaaaaaaaaaaaaaaaaaaaaa

SEQ ID NO: 319 - DNA, 505 bp, Glycine max
acgagggagagtgtgataaatttaagagagagagagaatatggtttccagagttcacaagagaatagccatgtacaggaacctacaactgcttcgttcaatcagatactcaaattcgcgccttaaagccttattgttactcgagctgtcagattacatacaaggtttaaagcaaaaactggaagaattgaaccagctgttaacagtggcaacggcacgaaaaatcgctgactatgatccaatgcctaagcttgaagttgaaacacaagaagaggcttttgtgatcaaggtgctgagtgaaagcagttgccaggggttgctggtgtttatattggaagcctttgaagagatgggtcttgatgtgctccaagctagggtttcttgtgcggacagcttcagtttagaagccatcggaaataataaagtaataatgtgacacccacatacataattatctaaatcctaaaagcaatacttaatattgtactgtgagtgcaatgtttgta

SEQ ID NO: 320 - DNA, 491 bp, Glycine max
ggctcgaggaggcgaagaagatgggtgtgcagatggagtgaggcttgttcagcttctaatagcatgtgcggaagcggtggcttgtcgtgacaaatcacacgcttccatattactatccgaacttaaagcgaatgctttagtgttcggatcctcattccaaagagttgcttcctgtttcgtccaaggcctgatcgagaggctcaatctgattcagcccatcgggcctgctggccccatgatgccctccatgatgaacatcatggacgtggcctcagacgaaatggaggaagcattcaggttggtttatgaactgtgtccgcacatccagttcggacactatttggctaattccacaatattggaagcctttgagggtgagagttttgtccatgtcgtggacctaggcatgagcctgggtctacgacacggacaccaatggagaggtctgatccagaatcttgccggtcgtgtaagcggcgaacgtgttcgtc

SEQ ID NO: 321 - DNA, 1954 bp, Glycine max
gtgagcttagcggagctgaagaagcagctacctaaagagagactcacacactcacattgtttatttgatgtgggttaaatggataccttgtttagactagtaagttttcatcaacagcaacaaccacaacaacaacctgatccatccctcaactccaccaccagcagaacctccagcagctccagatcctccagacaaaactactacccttattcccatcaagaagaagaagaatgcttcaacttttacatggatgaagaagacttatcctcgtcttcttccaaacactactaccacccttatcaaccccatcatcatcaacaacacaacgtatccaacatttctacaaacaccttcagcaccacccctaacactgattactcctactcctactccttctctcccacgcaacctgttcaagacttcaacttcgaattctcctcccccaactggtcccacaacctcctcctcgaatccgcacgcgccgtcgccgacaacaactccacgcgcctccaccacctcctctggatgctcaacgagctcagctccccctacggcgacaccgaacaaaaacttgctgcgtatttcctccgagccttgttcagccgcgtcaccgaagctggcgaccgaacctaccgaagcttagcttcggcgtctgagaaaacatgctcatttgaatccacaagaaaaacggtcctgaaattccaagaagttagcccttggactaccttcggacacgtggcatccaatggcgccatcttggaagccttggagggaaactccaaattgcatatacttgacatcagcaacacttattgcacccagtggccaatgcttctggaagcattggccactcggagcgaagaaactccacacctatgtttaacaacaattgttactggttctagaatcggtaacaacgtccagcgcgtgatgaaggaaatcggaacgcgaatggagaaattcgccagactcatgggcgttccttttaagttcaacgtcgttcatcactacggcgatctatccgagttcaatttctcagagcttgatatcaaagacgatgaggctttggctgtgaattgtgtgaactcgctgcattcggtttccgcgctaggaaacaaccgcgacgcgttgatatcggcgttgcaagcgttgcagccgcggattgtgacggtggtggaggaggaggctgatttggacgttggaatcgacggttacgagttcgtaaaaggctttgaagaaagtttgaggtggtttagggtttactttgaggctttggatgagagttttgtgaagacgagcaacgagaggctgatgctggagcgcgcggcggggagggcggtggtggacctggtggcgtgctcgccggcggattccgtggagcgccgcgagacggcggcgcggtgggcggcgaggcttcacaacggagggctaaacgcggcgccgtttagcgacgaagtttgcgacgacgtgagggcgctgttgaggaggtacaaggaagggtggtcgatggcggcgtgctccgacgccggaatattcctctcgtggaaggacacgccggtggtgtgggccagtgcatggaggccataacgtaaagatcgtatcataatagtatcatttggctttgacatgggtgaatccctcgcacgtgttctcggtttttttggcacgtgcggaaggatatatattgatggagttttttttcttcttttcagtattattaattattattattattgggctttatttcctatttttgttcttttggttaaatatatataagtttggtaagacaccgggattcatgggcgtttgcttgtgttgaaaaaggaactaagtaaattattattttcttaactttttatgattgatttttttgtttaccaaagaatagcttgtgtctttggatcgatatttgtatgacatgtttttcaatcgcttcaaaaaaaaaaaa

SEQ ID NO: 322 - DNA, 336 bp, Glycine max
ggaatgggtggtgtggggaagacaacacttgctcgagcaatttacaatttgattgctgatcaatttgaagtattgtgttttcttgataatgtgagagaaaactcaattaaaaatggattggtgcatctccaagagacacttctttctaaaacaattggagagaagggtattaagttaggaagtatcaacgaagcaattccaataataaagcataggctccaccgaaagaaggttcttttggttctggatgatgttgacaaaccagatcagttgcatgcaattgctggagggatggattggtttggttctggtagcaaaatcatcatcacaactagg

SEQ ID NO: 323 - DNA, 336 bp, Glycine max
ggaatgggcggggtgggaaaaacaacacttgctcgagctgtctataatgaattgataattgctgagaagtttgatggtttgtgttttcttgcaaatgtgagggaaaactcaaacaaacacgggttagaacacctccaaggaaagctgcttttagaaatactcggagagaagagcatcagcttaacaagtaagcaacaaggaatttcaatcatacagtctaggctcaagggaaagaaggttctcttgattatagatgatgttgacacacacgaccaattgcaagcaattgctggaagacctgattggtttggtcgcggcagcaggatcatcgtcaca

SEQ ID NO: 324 - DNA, 2479 bp, Glycine max
gaatttgggaaccggggcgtaccgggccccccctcgagtcagctaagtaggcccccccccccccccgaataatactaaacttttttcttcgaatggctaaaacatgttccggtgcatccagatacgatgtgttcattaacttcagaggggaagacacacgttttgcatttaccgggcatctccacaaagctctttgtaacaagggaatccgtgctttcatggatgaaaatgacattaagagaggagacgaaataagagcaacacttgaggaggcaattaaagggtcgaggattgccatcactgtgttctctaaagactatgcttcttcctcattttgcttagatgaacttgcaaccatccttggctgctaccgcgagaaaactctgttggttattcctgtcttttataaggtggatccttctgatgtaagacgcctgcaaggaagttatgcagaaggattggctaggcttgaggaaaggttccatcctaacatggagaattggaagaaggctctgcagaaagtagcagaattggctgggcatcatttcaaagatgggtatccctccttaccaagcttttgctttataatttttgttaaaattgaaagagaaaataaatgtttattaaccttgacaagatatggatacaagggttttagtttaacttcactacaactataatttcttgtttgaaacagagctggatatgaattcaagtttattaggaagattgttgatgatgtcttcgacaagattaataaagctgaagcaagtatatatgttgcggatcacccggttggattacacttagaagtggaaaaaataaggaaacttttggaggctggatctagtgatgctatctccatgatagggatccacggaatgggcggggtaggaaaatcaacacttgctcgagcagtttataatttgcatactgatcattttgatgattcgtgtttcctacaaaacgtgagagaagaatcaaacagacacgggttaaaacgcctacaaagcatccttctttcacaaatacttaagaaggaaatcaacttagcaagtgagcaacaaggcacttcgatgataaaaaataagctcaagggaaagaaggttctcttagttctagatgatgttgatgagcacaagcaattacaggcaattgttggaaaatctgtttggtctgagtctgagtttggcaccagattggttctgatcatcaccactcgggacaaacaactcctaacatcttatggggtcaaaagaacacatgaggtgaaagaattgagtaagaaagatgctattcaattgcttaaacggaaagcttttaaaacatatgatgaagttgatcaaagttacaatcaggtcttgaatgatgtagtaacttggacttctggccttccattggctttggaagtgataggttcgaacctgtttggaaaaagtattaaagaatgggaatcagctatcaaacaatatcaaagaattcccaataaggaaatcttgaagatacttaaagtaagctttgatgctttggaggaagaagaaaaaagtgtttttcttgacattacttgttgcttgaaaggctataaatgcagagagattgaagatatacttcacagtctttatgataactgcatgaaataccatattggggtgcttgttgacaagtctctcatacagattagtgacgatagagttacattgcatgacttgattgagaacatgggtaaagaaattgacagacagaaatcacctaaagagacagggaagcggaggagattatggttactaaaagatataattcaagtcttaaaagacaactcggggaccagtgaagttaaaatcatttgtcttgatttccccatatctgacaaacaagaaacaatagaatggaatggaaatgccttcaaggagatgaaaaaccttaaagcacttattatcagaaacggtattttatcccaaggtcccaattatctaccagaaagtttgagaatattggaatggcacagacatccttcccattgtttaccgtctgattttgatacaacgaatcttgccatacgcgacttggaatagttccatcccgtcattggggtgtggtggcatatccaaggcaagtttaaagaatacattttccttgtaaattaataaattcacagcagtattattcattcagttctgtttaaatttttccatcattttctttttgcagaagttgatgtatctaactatctaagggttttggatagctgatgcatctggtctctcaaatttgaaggaattttcatttgaatattgtgagaatttaattatagttcagagtcaattggttttctgaataaactttaaatattgagtgctggttgtttccgcaaacttaggagttttctacccatcaagggatggattgaatgaatgaaacaactgtgactcaaaaaaaaaaaaaaaaaaaaaaaaaaaaaaaaaaaaaaaaaaaaaaaaaa

SEQ ID NO: 325 - DNA, 1720 bp, Glycine max
ttttttttttttttttttgcacaaaatgataataatttaactttaaagagaactccatgatcatcaaccatccaacgatttaagacgaaaggaacaagtacaaccctcgaaagtgaattaggaagaaaacacaaggaaggaaaaccatacacagaagaagaatgctccaaggtagtctgtgttcttgaatgactttgacgacccagcactccattcacaatcatactaagttaactaattaacctttttttagttctcagtgctatgcaatcatcctcatcttcctttagttacagattcagcaacgatgtgttcctcagcttccgaggggaagatactcgtcacagttttaccggcaatctctataaagctctctctgacagaggaattcacaccttcatcgatgacaagaagctccctagaggagaccaaatcagctcagcacttgagaaggcaattgaagagtccagaatattcatcatcgtgctctctgaaaactatgcatcgtcctccttctgcttaaatgaacttggttacatccttaagtttattaaggggaagggcctattggttttgcctgttttttataaggttgatccttctgatgtgagaaaccatgcaggtagttttggagagtcattggctcatcatgaaaagaagttcaacgctgataaggagactttcaagtgtaacctggtgaagctggagacatggaagatggctcttcaccaagtggctaacttgtctggttaccatttcaaacatggttggactagagtcacgaatgcaagaagtaaaagcacttctggatgttggatctgatgatgttgtccacatgctggggatacatgggctgggtggagtagttggagagcataagttaataggtgtgaaacaaggaatttccataatacagcataggcttcagcaacagaagattcttttgattctagatgatgttgacaaaagggagcagctacaggcgcttgctggaagacctgatttgtttggtcttggcagtagagtcatcatcacgactcgggacaaacaattgctagcatgtcacggtgttgaacgaacatatgaggtgaatgaattgaatgaggaacatgctcttgaattacttagttggaaagctttcaagttggaaaaagttgatccattttacaaggatgttctgaatcgagcagcaacttatgcttcgggccttccattagctttagaagtaataggttccaacttatatggaagaaatatagaacaatggatatctgctttagatcgatacaaaagaatccctaataaagagatccaagagatacttaaagtgagttatgatgctttggaagaagatgagcaaagtgtttttcttgacattgcttgttgcttcaaaaaatatggtttggtagaggttgaagatatacttcatgctcatcatgggcattgcatgaaacatcatattggagtgttggttgaaaaatctctcataaagattagttttgatggtaacgtaacactacatgacttgatagaggacatgggtaaagaaattgtcaggcaagaatcagtcaaagaacctgggaaacgtagcagattatggtttccaaaggatatagttcaagttttagaagaaaataaggtgaataagattgatacttgaattatctcttttgattattatatccttatgtcccaacctcgtgccgaattcggcacgagg

SEQ ID NO: 326 - DNA, 567 bp, Glycine max
gggtctcgccttttcgttgtggtcttctctaagaactatgcttcctcaacttggtgcttgcgtgaacttgcacacatctgcaactgcactattgaagcatccccgggtcgtgttcttccaattttctatgatgttgatccatcagaggtgcggaaacagagtgcttattatgggatagcctttgaagaacacgaaggaagattcagagaagataaagagaagatggaggaagtactgagatggagagaagctctgacacaagtggccaatctctctggctgggatatccgaaataagtcacaacctgcaatgattaaagaaattgttcaaaacataaaatatatattgggtcccaaatttcaaaatcctccaaatggtaatctagttggtatggaatccagtgttgaagaattagaaaagtgtttagcattggagtcggttagtgacgttcgggttgtcggaattagtggaatgggaggaataggaaagacaactcttgcccgtgctttatacgaaaagattgctgatcaatatgattttcattgttttgttgatgatgtaaacaat

SEQ ID NO: 327 - DNA, 1753 bp, Glycine max
aaggctcacaaggctcgaagaatgaaaattccaagacacaattattagatttataatatttcttcactgcccacaataattgtcctcgcattccgcttctgaaattgcaatggcttctaaggccatcatccaatacagctcttcttcttcttcatctcatgcgatcatcactacatatgatgtgtttgtcagcttccgcggtgaagacacgcgcaacaacttcactgcttttctctttgatgctctctttgaaaatggcatccatgccttcaaagatgatacacatcttcagaaaggcgaatccatagcacccgagctgctacaggccattcaagggtctcgccttttccttgtggtattctctaagaactatgcttcctcaacttggtgtttgcgtgaacttgcacacatctgcaactgcactgatgaagcatccccgagtcatgttcttccgattttctatgatgttgatccatcagaggtgcggaaacagagtggttattatgggatagcctttgcagaacacgaagaaagattcagagaagatatggagaagatggaagaagtgcagagatggagggcagctctgattcgtgtggccaatctctctggttgggatatccgaaataagtaagtacaaatttatatgcagtcagtcatattatatccatgtgcatacatttcatcatttcttagtcacgttgttttatcaaacttactatcgctttctaaagtagagttcagagaagttgaggaggtaacatgcaaattgactctaaatttatacatgtttaacgcgaatggtgtttaaaaactttgaaattatcttatcctgtacatatatacattctgttgtggttctgataatttgccattctttattttctttaaattttcaggtcacaacctgcactgattaaagaagttgttcaaaatataaaatatatcctaggtcccaactttcaaaatcttccaaacggtaatctagtcgggatggaatccagtcttgaagaattagaaaagtgtttacgattagagtcggttaatggcgttcgtgttgttggaattagtggaatggggggaataggaaagacaactcttgcccgtgcattatacgaaaagatttctgatcaatatgattttcattgttttgttaatgatgtaaacaaaatttatcaacattctggttcactaggtatacaaaaacaattactttctcagtgtctaaatgatgaaaatttagagatttgtaatgtttctaagggaacatatatggtatcaactatgctacgcagtaaacaaggacttatagttcttgataatgttaataaggatgaacaactatgtatgtttacagggggtagagagactctattacatgaatgctttggtgaaggaagcagaatcattataatttcaaggaatgaacacatattaaggacatatggagtaaatcatgcttaccaagtccggccattgaatcaagacaaggctgttaagttattttgcataaatgctttccattgtaactatattatgagtgattatgaatggttgaaacgtgatgtactatcacatgctcaaggccatcccttggcaattaaagtaataggcaaatctttgtttggtcgaaatgtttcacagtggagaggtacattggttaggctaagtgataataaaagtaaggatattatggatgtgttgcgaataagttatgatgatctagaagaaaaagataaagaaatatttttag

SEQ ID NO: 328 - DNA, 1335 bp, Glycine max
acagttttgcaattgaaatggcttctacttctaatgccatcatccaatgcacctcttcttcttcttcttcgtttgagtatgacgtgtttgtgagcttccgcggtgaagacacacgcaacagcttcaccgcttttctttttgaagctctgaaaaaacaaggcatcgaggccttcaaagatgataaagatatcaggaaaggcgaatccatagcaccagagctaatacgagccattgaagggtctcatgttttcgttgttgtcttttccaaggactatgcttcctcaacttggtgcctgcgtgaactagcacatatctggaattgcattcaaacatcacgcagacctcttctgcctattttttatgatgttgatccatcacaagtgcgaaaacagagtggagactatgagaaagcctttgcccaacaccaacaaagttccaggttccaagagaaggaaattaaaacatggagagaagttctggaacaagtagccagtctctctggttgggatatcagaaataagcaacaacatgcagtgattgaagaaattgttcagcagataaaaaatatcttgggttgcaaattttctattcttccatatgataatctagttgggatggaatctcattttgctaaattatcaaagctaatatgtctggggccggttaatgatgatgttcgagttgttggaattactgggatgggtggaataggaaagtccactcttggtcgagctttatatgaaagaatctctcatcaatttaattctcgttgttatattgatgatgtaagtaaactttatcaaggttatggtacattaggtgtacaaaaagagttactttctcagtctctaaatgaaaaaaatctaaagatttgcaatgtatctaatggaacacttctggtatgggagaggctatccaatgcaaaggcacttataattcttgacaatgttgatcaagataaacagcttgatatgtttacagggggtagaaatgatctgttaggtaaatgcctaggtaaagggagcatagtcattataatttctagggatcaacaaatattgaaggcacatggagtagatgttatttaccgagtggagccattgaatgacaatgatgctcttggattgttttgcaaaaaagcattcaaaaataattatatgatgagtgattttaaaaagttgacttctgatgtattatcacattgtcaaggtcatcccttagcaattgaagtgctaggctcatctttgtttggtaaagatgtctctcattgggggagtgcattggtttcgttaaaaaaaaaaaaaaaaaaaagggcggccaccgactagtgagcac

SEQ ID NO: 329 - DNA, 898 bp, Glycine max
  misc_feature (51)..(51): n is a, c, g, or t
aaatttcctgtttcacagaaatggctgatagtgttgttgtttttctactanataacttgtctcggctgcttgaagatgaacacaagttgctttctggcgtggaggacaaaatcaactctctttgcaatgagctcaagtttatacacatcttcctcaagaattctgagggcaagcgcagtcacgggctcgtgaaagaagtggtgagccagatcagagatgtcgccctcaaagctcaagatgtggttgacacctacctttccaacatcgccccacaaaaacagaggagcaaactgagcaagttattccacctcaaagaacatgtcatggtgcttcaccaagtcaactctgacatagagaagatcaggagtcggatcgatgagatctataagaacagggacagatatggcattggagaaagtgaattccgaagcgaagaagctgctgcagaagcagaatcactcctcaaaagaaggagggaggtggaggaagaagatatagtgggcttagtgcatgactcaagccatgtaattcatgaactcatggaaagtgagtcacgtcttaaagttgtgtccataattggaatgggagggttgggtaagaccactcttgcccgtaagatctataacaacaatcaagtgcagctgcggtttccttgccttgcatgggtttctgtgtccaatgattacagacccaaggaatgtcttctcagccttctcaaatgttcaatgtcttccacatctgaatttgaaaaattaagtgaggaagatctgaagaagaaggtagcagaatggttgaaagggaagagttatctggtagtgcttgatgacatctgggaaaccaaagtatgggatgaggttaaaggagcctttccagatgaccaaataggtagtagaattct

SEQ ID NO: 330 - DNA, 3892 bp, Glycine max
gttttgcaattgtaatggcttctacttctaatgccatcatccaatgctcctcttcttcttcgtttgagtatgacgtgtttgtgagcttccgcggtgaagacacacgcaacagcttcaccgctttcctttttgaagctctgaaaaaagaaggcatcgaggccttcaaagatgataaagatatcaggaaaggcgaatccatagcaccagagctaatacgagccattgaagggtctcatgttttccttgttgtcttttccaaggactatgcttcctcaacttggtgcctgcgtgaactagcacatatctggaattgctttcaaccatctaccagacatcttctgcctattttctatgatgttgatccatcacaagtgcgaaaactgagtggagactatgagaaagcctttgcccaacaccaacaaagttccaggttccaagagaaggaaattacaacatggagagaagttctggaacgagtagccagtctctctggttgggatatcagaaataaggaacaacctacagtgattgatgaaattgttcagaagataaaaaaaatcgtgggttgcaaattttctattcttcgaaatgataatctagttgggatggaatctcatttttctacattatcaaagcagctggggccggttaatgatgttcgagttgttggaattactgggatgggtggaataggaaagtccactcttggtcgagctttatatgaaagaatctctcatcaatttaattcttcttgttatattgatgacgtaagcaaactttatcgactggaaggttcagcaggtgtacaaaaagacttactttctcagtctctaaatgaaacaaatctaaagatttggaatttatcttatggaacagaactggcatggaggaggctacacaatgcaaaggcacttatagttcttgacaatgttgaagaagataaacagcttaatatgtttactgcgaatagaaagaatctgttacgtgaacgccttggtagaggaagcatagtcattataatttctagggatcaacaaatattgaaggcacgtggagcagatcttatttaccaagtgaagccattggatgacaccgatgctcttcgattgttttgcaaaaatgcatttaaaaataattatattatgagtgattttaaaacgttgacttctcatgtactatcacattgtgaaggtcatcccttagcaattgaagtattgggctcatctttgtttggtaaagatgtctcttattgggggagtgcattggtttccttaagagaaagtaaaagtattatggatgtgttgcgaataagttttgatcaattggaggatacacacaaggaaatatttctagatattgcatgtttcttgtacgatcatgatgtgatatatgtgaaggaaattctagattttcgtggatttaatcccgaatacggcctacaagttctcgttgataaatcacttataaccatgcgtaggatagttgaaatgcatgacgttttgcgcaatttgggcaagtatattgttagagaaaaatcaccttggaatccatggaagtggagtaggttgtgggatttcaaagatctcaacatagtttcgttggataataaggcaacagaaaatgttgaggccatagttcatgaagaagactatgacattgaaaaagactctgacttagaagaagactctaacttagaagactatgacttagaagactctgacttagaagaagactctgacttagaagactatgacttagaagaagactctgacttagaagactatgacttagaagaagactctgacttagaagactctcactttcttccaacagtgagggtggatgctctatcaacaatgagtaaccttaaacttctcaaatttagatacgctggctacgaaatcaattattcaggaacacttactaagctttccaatgaattaggatatcttacttgggtaaagtatccttttgagtgtttgccaccaagttttgagccggacaaacttgttgagttgattctacctaaaagcaacatcaaacaactttgggaagatagaaagataatatcaattattattattattatttttctatattgttttcatttaaataaacaaataaaaaggcaaactttcttatgataattcctttttctctatttaattaaagaaacaaaagaaaggctgaatgtcattattaattttgtttcctactattggtcttgcattgtagcctctacccaatttgaggcgtttggatctctctgactccaaaaatctaataaaaatgccgtatattggagatgccctgtatcttgagagtcttaatctcgaaggatatatacaactcgaagagatcggcctgtccattgttctttcaccaaagcttacttctctgaatttgagaaattgcaaaagtcttatcaagttgccacggtttggagaggaccttattcttgaaaatctatatctggaaggatgtcataaactcagacacattgatccatccatcggtcttctataaaagctcaaatatttgaatttggaaaactgctaaaatctagtaagcttacccaatagcatactaggcctcaattctcttgaatatctgtatctctctggctgttcaaaactgtacaacaccgagttattatatgaactaaggggtgcagagcaattgaagaagattgatatagatggagctcctattcatttccaatcaacatcttccaactccatagaacataaaaaatcagttagttgctcaatgccttcctccccaatatttccatgtatgcgtgaacttgatctaagtttctgtaatttagttgaaatccctgatgctattggagttatgagttgcttacgatggctagatttaagtggcaacaattttgctacactgcccaacctcaagaagctttccaaactgttctgtttaaagttacaacattgcaagcagttgaaatctttgcctgagctcccttcacggattaacaattttgatggactaagacaagcaggattacacatttttaactgcccagaattagttgatagggaacgctgcactgacatggctttttcatggatgatgcaattgtttcacggatggatgaacaaccaggtggattacatgattggaagtgttagtccaggaagtgaaataccaaggtggttcaataatgagcatgagggaaattgtgtaagcttagacgcatctcctgttatgcatgaccataattggattggcgttgcgttttgtgcaatattcatcgtacctcatgaaacactctcagcgatgccttttacagaaacagaatggccatggtctttgcttggtgatattccagtggatttttatgtagatctagatctagaacttgttttagacaaatcagatcacatgtggctattctttctggatcgagatgactccattcgcgaattacatctcaagcacaaatatcttggcagattgcttttgcaatgtgatgatgaagggacagtgttgaaagagtcatatgctgaggtgaagaaatacggatatcgctgggtatataaaggggatatagaatcgttgggtagaaagcgcaaatttggggaaattgaagaaaatgaaggaataatgtgagcagaagggagaaaagatgatgcaagctcctcccaggaaaacacaatcaacttgaatcttagggtgtagaatcatcatttcttctctcattttattcatttgagtcgtctttcactcatcccaacaattcacaagtggcataaaggggactgatgcaaattttgttggtggcataaaatcaggtttttggttgttatgggataattgtgtagttgtctttgttggttaagaattttttttttcctttttttggttt

SEQ ID NO: 331 - DNA, 3128 bp, Glycine max
atggcagaaactgcagtatcttttgccttggaaagagtgttccaaatcctaacggaagaaacaaacctgctaagaggcacccacaaagattttttaggcatcagagatgaactagagagcattcaagctttcctcaaagatgcagatagaagggctgcagatgaagccaacaccaaggctggaatcagaacatgggtgaagcaggtcagagaagcatcatttcgaatagaagatgtcattgatgaatacctcagggtgattcatggggtccaacatcttggatgtggggcttcaatttgcaagattacgagcctcatcagcacagtgacttctcgtcatcagatagcaactgagattcaggacatcaaagtgtcactttctctaatcaaggaaagaagtgaaagatataagtttcaagtttcacaagaacaacaatcaagcagcaacactgaagcgatagaaggcagtagatggcatgattctagaatgagatcccttttcattgaagaaactgaaattgtaggatttgaattccctaaagatgaattggttggttggttgttgaagggcacaaaagagcccacggtgatttcagtagtagggatgggaggacttggaaaaaccacacttgccaagcacgttttttgcagtgaaaaggtaaaaaggcactttgattgtcgggcttgcatcacagtttctcaatcatacactgtgaaagggttattcatagacatgataaaacaattttgtaaggagaccaaaaaccctcttccagaaatgttacacgaaatggacgagaagtcactaatttctgaagtgaggcaatacttgcagcataaaaagtacttgatattctttgatgatgtatggcatgaagatttttgtgaccaagttgaactggccatgcttaataacaatgaaagtagcaggatcataatcaccactagaatgatgcatgttgctgagtttttcaagaaatcctttcctgttcatattctcagcctacaactgttgcctccagacaaagcatgggaactcttttgcaagaaggcattcagatttgagctacacgggcaatgtcctgcactgcttgaaggtatgtcagatgaaattgttagaaaatgcaaggggctgcctttggcgattgtagccattggtggtctactttcaacaaaatcaaaaactgtctttgaatggcaaaaggtgaatcaaaatctaaacctcgagttgcagcgtaatgcccatctcactagtataacaaagattttatctctcagttatgatgacctgccttactatttgaaaccatgcattttgtattttggaatatatccacaggactactccattaatcataacaggttaacacgacaatggatagctgaagggtttgttcagtctgatggaagaagaacttcagagcaaattgcagatgagtacttatccgagttaatttatagaagcctggttcaagtctcaacagttggctttgaagggaaagttaaaagttgtcgagtccatgatttattacacgaagtgatagtaagaaaaatgaaggacttaagtttttgccattttgtgaatgaaggtgatgatgaatcagccacaattggagcaactagacgcctatctatagacactagttccaacaatgtgttaaagagcactaacagcacacatattcgtgctatccattgttttggaaaaggagaacagctcgagccttttatgggtcaactattttcgaagtctagggttatgaaagtactcaaccttgaaggtacattgttaaattatgttcccagtaatctagggaatcttttccacttaaggtacataaatctaaagaatactaaagtacggattcttcccaattctgttggtaagttacagaacctagagaccttggatatcagaaacacgttggttcatgagttaccaagtgaaataaacatgctcaaaaagttaagatatcttcttgctttccatcgaaactatgaagcagattattctcttttgggatctacaactggtgtgctaatgaaaaaaggtattcaaaatttgacttccttacaaaacctttgttatgtggaggcagatcatgggggcatagatctcatccaagagatgagatttttaaggcagttaaggaagttaggcttaaggtgtgttcgaagggaatatgggaatgcaatatgtgcttcagtggaagaaatgaaacaacttgaatcacttaatatcactgcaatagctcaagatgaaatcattgacttgaactctatatcatccctaccccaacttcgacgacttcatttgaaagcaagactggagaagatgcctaattggatttcaacacttgagtttcttgttaaaataaggctggctttatccaatttgaaagatgatccgttgagatcgctagaaaagttgccaagtttgttgaaggttagtatttgggacaatgcctatgatggtcaaattttgcattttcgaagtggagggtttcgcaaattgaaggaattgtatctagctcgcttggatagagtaaattctgtcctaatagataaaggaagtttgctttctcttgaaaattttataatttgcaaaatcccccatctcaagaagctaccctctggcatcgaagccttggataaccttaaagttattgacttccgtgatatgccaactgagcttgttgagagcattgatccaaaaaaaggtcaagattatgagattatcaatcaagtgcccctagtaatcattcgtcattggattggcccaaaactcagtgattttgaagtccgcgctattcactcgtcctcccagaaatcataaacataatgattatgctttgatgcctaatatgaagatttccaggttttagtttatgcaattcgtcttgaaaggtgaacctctgagtagagatagcaatgagtaggatttaggctgttggagctgctcttaaagcttgcaatcaagacgacttcatttgaatgagcattttcattttcatgataaagacaaatgtaatttctgtattgtcattggattcgttgtcatgatggaacctactgttgtttgccaattatttttcctgtattctaaactttagtctgccttctattggt

SEQ ID NO: 332 - DNA, 1121 bp, Glycine max
  misc_feature (1039)..(1040): n is a, c, g, or t
acacgtcatcaaacacgacaacatacctattgtggctcaagtgatttctcacctcacgtatcaacgatgctttatccattgtagaatcctctcttttttctgcttctagaaacttgagcaacaacccttctatggtgtatgactgagacactgtgatccagacatggcgagggaagtgtgtctggactttgtcaaaaactttcttggcaagagtagtttttccacttcctcccattcctaccacagagacaacagtgagctttttccgcccctctttcaaccatctttccaatgtgtctctagggctgtcaaagcccacaacctcagcctccttaagaaacagaggagccattcgaaggttgtcgaacgtgatgttttggggtcctcgagaagattgaatttgggagcaatcctcagttttgttcctctccttgatcccacgaaattctgatttcacgtcctggttcatgtatgcaaattgaagacgagaggccgtagttttgacgaaatcaatagccttacaaggtaaagatgcacatccaggatcatcagcaagctgcctttcctcatggataatgtattcatcaacgatatcttccatgcaaaaagatgtttccaccagctgcttcacctttgctttgagaccatcacgtgagttgccttcttcagctgctgccatcttgtccacatcatgaatcatggcttgaatcccatcaagtttgtctttcatgtctgcagcatcttttggaacctccatgactgaattcactgctttctttaagggtggaagcaaataatcaacagccaaggacactgcaatttcttgcaatttctgcatcttagtatagatctagtttctgctattgttatgtgttgagagtgagatgagaagaaagtaaagtgtgtctttcaagaggaagactttcactttcccttggtcattctttagtgttcaattattgagcaagttgcacggagggcacggtcaatgagattgtcttattgctgatctgttaatgtaattaaacaaataaaaganntagtgaggagcaagttgcaggagcgtacccagtgagattgtgattgtaatttaccaatagaaaaaaaaatgtcacacttgg

SEQ ID NO: 333 - DNA, 1885 bp, Glycine max
  misc_feature (1832)..(1833): n is a, c, g, or t
cgacgccgccctcatagaaaagaaattaattgtattgatactgtatttgagaagatgaagaatcttcgaattcttatcgttcgtaacacaagcttttgacatgagcctcgttatctcccaaaaaacttaaggctacttgattggaagaactacccttcaaagtctttgccatcagaatttaatcccactaaaatcagtgccttcaatggaagtcctcaactcttactggaaaagccatttcagtttgaccatttgacttacatgaatatctccggttgtgataaggtttctgaatttcctgatgtgtctagagccatgaatttaagaaaattgatacttgatggatgcgagaacctggttagcattcataaatcagttggacatctcgctaaccttgtttctcttagtgcttcaaattgcacacaactccatagttttgtgccaacaatctatttgccatctcttgaatccctttcctttgttctttgcacaacactcgcacactttccagatatcgaaggaaagatggataagccattagagattgttatgtcatatacagctattcagaagcttccagattccatcaaggaacttaatggccttacctatcttgagatgacaggttgtgaggaactccgatatttaccaagtagcttatttaagttgccaaatttggtcacattaaaacttgcagaatgtgctttccttccaaggtcattgagaatgtttataggaagtccttcaacgtgcgcaaaactagagacattacatttcgacaatactgggctgacagactatgatcttaagactattgttgccatttttcctaacttgaaagacttgaatgtatcgcggaacagattttctgatctcacattgagcattgggaaatttactaacttgacaagtcttgacgtgagttattgtacggaccttaaaggaatgccttcaatactgccatcaagtgttcagaaagtagatgcaagagaatgtcgatccttaaatcaattttcatcaaacgccttatggattcaggtttactagcactactttagctgataacgagcaaatgttttctgacgaaaaatgatcacataaatatcatagtcattaagatatattttctgttgaccggtgtagttccacaatttcatttccattcattcctcccattttatttcattgttaacaaaagaaaacacaattaaaagacaataattaagattttgttttttgtttgtgggatgtgtcgcaggtaaaaaaagaaaagaatgaattagaagtcatgatgccaaaaagggagattccaaaatggttccactatgttaacaagggacggtttccggatttcaaggctcgtgggaagttccctgcggttgctatagcgtttgtatttggggaagtgaatgccattgacaaagctaatagaagtataaatgttggcattcacttgttgattgaggatgaaaggagaaagtttcgtaatgtccctgtccctgagaatcatgtgttcttgtgtgacctacgaggtttgttcagtttggaagaatgggaggatgtaggtgttggagttggtaatgattggaagaccatacaggtttactgtgacacaaagttgcctctatgttcatggggagtttatgtgtacaagagtgaaagtaacatgaaatatatccaattcccgtctaatgatccctgttcctccttctaaactagccgagcgttgctgcagcaacctccatccaccacaatggttcaatgatgtcatttgctaagcagcctttttgttttcttagttttcaataattgctagagtacatacgtgtaanngctcagattatctgaccatgaaattaaagtagctttatattgtgttgacaga

SEQ ID NO: 334 - DNA, 419 bp, Glycine max
gaaaatcagtcaaccaaagtttgtatcgtagggatatggggaatgggaggattgggtaaaactaccacagccaaagccatctacaatcgaatccatcgtagattcacgggtagatgtttcattgaagatattcgagaagtttgtgaaacagatagaagagggcatgttcatttgcaagaacaacttctttcaaatgtccttaaaacaaaggtgaacataaaaagcgttgggataggaagagctatgatggagagcaaactttctggaagaaaggcactcattgtacttgatgatgttaatgagtttggccagttaaaagtcctatgcggaaatcgtaaatggtttggtcaaggaagtatagtaatcattacaactagagatgtacgcctacttcacaaacttaaagttgagtttgttta

SEQ ID NO: 335 - DNA, 2832 bp, Glycine max
atggcagaaacagcagtatcttttgccttaggagaagtttacgaaatcctaaaggacgaagcaaagctgctaagaggcatccacaaagacttttcagacatcaaagatgaactagaaagcattcaagccttcctcaaagatgcagatagaagggctgcagatgaagcaaacaccaatgatggaataagaacttgggtgaagcaggtcagagaagcatcatttcgtatagaagatgtaattgatgaatacctcagggtgattcatgtggtccaacatcttggatgtggggcttcaatttgcaagattacacacctgatcagcacattgatttctcgtcatcagatagcaacagagattcaggacattaaattgtcactttctgtaattaaggaaagaagtgaaaggtataagtttcaagtttcacaagaacaaccatcaagcagcagcactggagggatagaaggtagtagatggcatgatcctagaatgagttcccttttcatcgaggaaactgaaattgtaggatttgaattgccaagagatgaattggttgcttggttgttgaagggcacagaagagcgcacagtaatttctgtggtagggatgggaggacttggaaaaaccactctttgcaagcacgtctttgatagtgaaaatgtaaaaagtcactttgattgtcgtgcttgcatcacagtttctcaatcatacactgtcagagggttattcatagacatgataaagcaattctgtagggagacaaaagaccctcttccacaaatgttacatgaaatggatgagaagtcattaatttctgaattgaggcaatacttggagcataaaaggtatttgatattctttgatgatgtatggcatgaagatttttgtgaccaagttgaattttccatgcctaataacaataaaagaagcaggatcataatcaccactagactgatgcacgttgctgagtttttcaagaaatcctttcctgttcatgttcacagcctacaactgttgcctccagacaaagcatgggaactcttttgcaagaaggcatttagatttgagctaggtgggaaatgtccagcagagcttcaaggtatgtcaaacaaaattgttagaaaatgtaaggggctacctttggcgattgtggccattggtggtctattgtcaacaaaatctaaaactgtgtttgaatggcaaaaggtgatccaaaatctaaacctggagttgcagcgtaacccccatctaactagtttaactaagattttgtctcttagttatgataacctgccttaccatttgaaaccatgccttttgtatttgggtatatatccagaggactactccattaatcacacaagtttaactcgacaatggatagctgaaggatttgttaaatctgatgggagaagaactatagagcaggttgcagatgagtacttatctgagttaatctatagaagtctgattcaagtctcgagcataggctttgaagggaaagttaaaaattgtcaagtccatgatttattacatgaagtgatcgtaagaaaaatggaggacttgagtttttgccattttttgtatgaaggtgatgatgaatcagccacacttggaacaattagacgcctatctatagacactagttccaacaaagtgttgaagagcactaacaacgcacacattcgtgctattcatgcttttaaaaaaggaggactgcttgacatttttatgggtctcttatcttcgaagtctaggcctttgaaagtactcgaccttgaaggtacattgttaagttatgttcctagtaatttagggaatctttttcacttaaggtacctaaatctaaggaatactaaagtacaggttcttcctaaatctgttgggaagttaaagaacctagagaccctggatataagagatacgttggttcatgagtttccaagtgaaataaacaagctcaaacagttacgacatcttcttgctttccatcgaaactatgaagctgagtattctctgttgggatttacaactggagttgtaatgaaaaagggtattaaaaacttgacttccctacaaaatctttgctatgtggaggttgaacatgcaggaattgatctcatccaagagatgagattcttaaggcagttaaggaagttaggcttaaggtgtgttcgaagggaatatgggaatgcaatatgtgcttcagtggaagagatgaaacaacttgaatcacttaatatcactgcaatagctcaagatgaaatcattgacttgaactctatatcatccctaccccaacttcgacgacttcatttgaaagcaagactggagaagatgcctaattggatttcaacacttgagtttcttgttaaaataaggctggctttatccaatttgaaagatgatccgttgagatcgctagaaaagttgccaagtttgttgaaggttagtatttgggacaatgcctatgatggtcaaattttgcattttcgaagtggaggttttccaaaattgaaggaattgtatcttgctcggttgaatagagtaaattctatcctcatagacaaaggagctttgctttctcttgaaaattttaaacttaacaaaatgccccatctcaaggaggtaccctctggcatcaaagccttggataacctcaaagctcttgatttccttgacatgccaactgaatttgttgagagcattgatccacaaaatggacaaaattattggatcatcaatcatgttccccttgtattcattcgccactggattggcccaaaactcaatgattttgaagtccgcaccattcgcttgttctacagggagtga

SEQ ID NO: 336 - DNA, 3129 bp, Glycine max
atggcagaaattgccgtagcatttgccttggggcaagtgttccaaatcctaaatgatgagacaaacctgttaggaggcatccacaaagatttttcaaacatcagagatgaactagaaagcattcaagctttcctcaaagatgcagatagaaaggctgcagatgaagcaaacaccaaccatggaataagaacatgggtgaagcaagtgagagaagcatcatttcgtatagaagatatcattgatgaatacctcagggtgattcatgtggttccccaccttggatgtgaggcttcaatttgcaagattacaagcctgataaaaacatcaatttctcgccatcagatagctactaagattcaggacattaagttgtcaatttctgtaatcaaggaaagaagtgaaaggtataagtttcaaccttcacaagaaccaccatcaagcagcagcaccagaatgggttccctttttattgaagaaactgaaattgtaggatttaaattgccaagagatgaattggttggttggctgttgaagggcacagaagagcgaacagtgatttcagtggtagggatgggaggacttggaaaaaccactcttgccaagcatgtttttgatagtgaaaaagtaaaaggtcactttgattatcgtgcttgcatcacagtttctcaatcatacagtgtcagagggttattcatagaaatgataaagcaattttgtagggaggcaaaagaccctcttccagaaatgttacacgaaatggacgagaagtcactaatttctgaagcgaggcaatacttgcagcacaaaaggtatttgatattctttgatgatgtatggcatgaagatttttgtgaccaagttgaatttgccatgcctaataacaatagaagtagcaggatcataatcaccactagaatgatgcatgttgctgagtttttcaagaaatcctttcctgttcatattctcagcctacaactgttgcctccagacaaagcatgggaactcttttgcaagaaggcattcagatttgagctacacgggcaatgtcctgcactgcttgaaggtatgtcaaatgaaattgttagaaaatgcaaggggctgcctttggcgattgtagccattggtggtctactttcaacaaaatcaaaaactgtctttgaatggcaaaaggtgaatcaaaatctaaacctcgagttgcagcgtaatgcccacctcactagtataacaaagattttatctctcagttatgatgacctgccttactatttgaaaccatgcattttgtattttggaatatatccacaggactactccattaatcataacaggttaacacgacaatggatagctgaagggtttgttcagtctgatggaagaagaacttcagagcaaattgcagatgagtacttatccgagttaatttatagaagcctggttcaagtctcaacagttggctttgaagggaaagttaaaagttgtcaagtccatgatatattacatgaaatgatagtaagaaaattgaaggacttgtgtttttgccattttgtgcatggaggtgatgagtcagccacaagtggaacaactagacgcttatctgtagacattagttccaacaatgtgttgaagagcactaactacacacacattcgtgctattcatgtttttgggaaaggaggactgcttgagcttttcacgggtctcttatcttcaaagtcaagggttttgaaagtactcgaccttcatggtacatccttaaattatatttcaggtaatttagggaatctttttcacttaaggtacctaaatctaaggggtacgaaagtacaggttcttcctaaatctcttggtaagttgcagaacttagagaccttggacataagagacacattggttcatgagttaccaagtgaaataaacatgctcaaaaagttaaggcatcttcttgctttccatcgaaactatgaagcacgttattctctcttgggatttacaactggtgtgctaatggaaaagggtattaaaaacttgacttccctattaaaactttgctatgtggaggtagatcatggtgggatagatctcatccaagagatgaaattcttatggcaattaagcaagttaggcttaaggcgtgttcggagggaatatgggaatgcaatatgtgcttccgtggtagagatgaaacaccttgaatcacttgatatcactgcaataggtgaggatgaaatcattgacttgaaccctatatcatccctaccccaacttcaacgccttaaattgaaaacaagactggagaagatgcctaattggatttcaaaacttgagtttcttgttgagataaggctgggtttatccaatttgaaagatgatcttttaagatcggtagaaaacttgccaaatttgttgaagcttggtatttgggacaatgcctatggtggtgaaattttgcattttcaaagtggagggtttccaaaattgaaggaactgtatctagctcgcttgaatagagtaaattctgtattaatagataaaggaagtttgctttctcttgaatattttataattgccaaaatcccccatctcaagaagctatcctcaggcatcaaagccttggataaccttaaagttattgacttccgtgatatgtcaactgagcttgttgagagcattgatccaaaaaaaggtcaagattatgagatcatcaatcatgttccccaacttttcaaaatgttcgtgtatttcctttatcaccttcatcctctcacccacttgaaagttctcaaaattatgttatcgaattcacgactcttccctcacgctgatgatcatctttttcgagaagcactgtccaagctcgcagagcgtcgattggatgcaggcataggggtacacgtagaactgcaccagccagccacgggagccgccatcatcgtccatcaagcaacgcaggtgctcgccagcgtagagggtctgggtcatgtcttgcgactgaatgttgtggtcgagtgtggtggtgattgtcgtatcttggttccctgtgaactccacatgccacatagtattattctctttggaagtacaccaactatatcttctttgcattcattttctttcatcctcacattttaa

SEQ ID NO: 337 - DNA, 1019 bp, Glycine max
attcggctcgagcactttcctacaattttcttttcatcacaaaacaacccctcgcatatattatatttgttgattcattatttgtatccacaaacacttgttcttccttcacagctttgcaattgaaatggcttttacttctaatgacgtcatccaatgcacctcttcttcttcgtttgagtatgacgtgtttgtgagcttccgcggtgaagacacacgcaacagcttcaccggttttcttcttcaagctctgaaaaaagaaggcatcgaggccttcaaagatgataaagatatcaggaaaggcgaatccatagcaccagagctaatacgagccattgaagggtctcatgttttcctttgtcttttccaaggactatgcttcctcaacttggtgcctgcgtgaactagcacatatcaggaattgcattcaaacatcacccagacatcttctgcctattttttatgatgttgatccatcacaagtgcgaaaacagagtggagactatcagaaagcctttgcccaacaccaacaaagtttcaggttccaagagaaggaaattaacatatggagagaagttctggaactagtagccaatctctctggttgggatatcagatataagcaacaacatgcagtgattgaagaaattgtccagcagataaaaaatatcttgggttccaaattttcaactcttccatatgataatctagttgggatggaatctcattttgctaaattatcaaagctaatatgtctgggaccagctaatgatgttcgagttgttggaattactgggatgggtggaataggaaagtcaactcttggtcgagctttatatgaaagaatctctcatcaatttaattctctttgttatattgatgatgtaagcaaactttatcaacgtgatggtatattaggtgtacaaaagcaattactttctcaatctttaaatgaaagaaatctagagatttggaatgtatctgatggaacatttctggcttggaaaaagctatcccat

SEQ ID NO: 338 - DNA, 850 bp, Glycine max
catagttttgcaattgatcaaatggcttctacttctaaggccatcatccaatgcacctcttcttcttcttcttcttcgtttgagtatgacgtgtttgtgagcttccgcggtgaagacacacgcaacagcttcaccgcttttctttttgaagctctgaaaaaacaaggcatcgaggccttcaaagatgataaagatatcaggaaaggcgaatccatagcaccagagctaatacgagccattgaagggtctcatgttttccttgttgtcttttccaaggactatgcttcctcaacttggtgcctgcgtgaactagcacatatctggaattgcattcgaacatcttccagacttcttctgcctattttctatgatgttgatccatcacaagtgcgaaaacagagtggagactatgagaaagccttttcccaacaccaacaaagttccaggttcctttataaggaaattaaaacatggagaaaagttctgaaccatgtaggcaatctctctggttgggatatcagaaataagcaacaacatgcagtgattgaagaaattgttcagcggataaaaaatatcttgggttgcaaattttctactcttccatgtgataatcgagttggtatggaatctcattttgctacattatcaaagctaatatttctggggccggttaatgatgatgttcgagttgttggaattactgggatgggtggaataggaaagtccactcttggtccagctttatatgaaagtatctctcatcaatttaaatccttgttgttatattgatgatgtaagaaacaatcataaacgtgaaaggccattaggtgtacaaaagcaattactttct

SEQ ID NO: 339 - DNA, 1765 bp, Glycine max
attcggctcgaggagactatgagaaagcctttgcccaacaccaacaaagttccaggttccaagagaaggaaattacaacatggagagaagttctggaacgagtagccagtctctctggttgggatatcagaaataaggaacaacctacagtgattgatgaaattgttcagaagataaaaaaaatcgtgggttgcaaattttctattcttcgaaatgataatctagttgggatggaatctcatttttctacattatcaaagcagctggggccggttaatgatgttcgagttgttggaattactgggatgggtggaataggaaagtccactcttggtcgagctttatatgaaagaatctctcatcaatttaattcttcttgttatattgatgacgtaagcaaactttatcgactggaaggttcagcaggtgtacaaaaagacttactttctcagtctctaaatgaaacaaatctaaagatttggaatttatcttatggaacagaactggcatggaggaggctacacaatgcaaaggcacttatagttcttgacaatgttgaagaagataaacagcttaatatgtttactgcgaatagaaagaatctgttacgtgaacgccttggtagaggaagcatagtcattataatttctagggatcaacaaatattgaaggcacgtggagcagatcttatttaccaagtgaagccattggatgacaccgatgctcttcgattgttttgcaaaaatgcatttaaaaataattatattatgagtgattttaaaacgttgacttctcatgtactatcacattgtgaaggtcatcccttagcaattgaagtattgggctcatctttgtttggtaaagatgtctcttattgggggagtgcattggtttccttaagagaaagtaaaagtattatggatgtgttgcgaataagttttgatcaattggaggatacacacaaggaaatatttctagatattgcatgtttcttgtacgatcatgatgtgatatatgtgaaggaaattctagattttcgtggatttaatcccgaatacggcctacaagttctcgttgataaatcacttataaccatgcgtaggatagttgaaatgcatgacgttttgcgcaatttgggcaagtatattgttagagaaaaatcaccttggaatccatggaagtggagtaggttgtgggatttcaaagatctcaacatagtttcgttggataataaggcaacagaaaatgttgaggccatagttcatgaagaagactatgacattgaaaaagactctgacttagaagaagactctaacttagaagactatgacttagaagactctgacttagaagaagactctgacttagaagactatgacttagaagaagactctgacttagaagactatgacttagaagaagactctgacttagaagactctcactttcttccaacagtgagggtggatgctctatcaacaatgagtaaccttaaacttctcaaatttagatacgctggctacgaaatcaattattcaggaacacttactaagctttccaatgaattaggatatcttacttgggtaaagtatccttttgagtgtttgccaccaagttttgagccggacaaacttgttgagttgattctacctaaaagcaacatcaaacaactttgggaagatagaaagataatatcaattattattattattatttttctatattgttttcatttaaataaacaaataaaaaggcaaactttctt

SEQ ID NO: 340 - DNA, 687 bp, Glycine max
atggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaagttttggcaaagggaggcagcaatgttaaggcaacaattacacaatttgcaagaaagtcaccgcaggaaaatgatgggggaagaactgtcaggcttgacagtcaaagaattacaaaatttggagaaccaattagaaattagccttcatggtgtccgaatgaaaaaggatcaacttttaatgggtgaaatacaagagctaaatcgaaagggaaacctcatacaccaagaaaatgtggaactgtataagaaggtctatggaacacaagatgataacgaaacaaacagagattctgttctgacaaatggtctaggcataggagaggatttgcaagtgcctgtgaatctccagctaagccagccacagcaacagcaacaacactacaaggcatcttcaggaactacaaaattgggattgcaattgcattga

SEQ ID NO: 341 - DNA, 684 bp, Glycine max
atggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaagttttggcaaagggaggcagcaatgttaaggcaacaattacacaatttgcaagaaagtcaccgcaggaaaatgatgggggaagaactgtcaggcttgacagtcaaagaattacaaaatttggagaaccaattagaaattagccttcatggtgtccgaatgaaaaaggatcaacttttaatgggtgaaatacaagagctaaatcgaaagggaaacctcatacaccaagaaaatgtggaactgtataagaaggtctatggaacacaagatgataacgaaacaaacagagattctgttctgacaaatggtctaggcataggagaggatttgcaagtgcctgtgaatctccagctaagccagccacagcaacagcaacaacactacaaggcatcttcaggaactacaaaattgggattgcaattgcat

SEQ ID NO: 342 - DNA, 684 bp, Glycine max; identical to SEQ ID NO: 341

SEQ ID NO: 343 - DNA, 941 bp, Glycine max
gggagaggtaagatcgtgataaggaggatcgacaattccacgagcaggcaagtgacgttctcgaagcggaggagcggtttgctgaagaaggcgaaggagcttgcgatcttgtgcgatgctgaagtcggagttatgatcttctccagcaccggaaaactctacgattttgccagctccggcatgaaatcagtaattgaccgatacaacaaatcaaaagaagaaccttgtcaacttgggagttcagcttcagtaattaagttttggcaaagggaggcagcaatgttaaggcaacaattacacaatttgcaagaaagtcaccggaaaatgatgggggaagaactgtcaggcttgacagtcaaagaattacaaaatttggagaaccaattagaaattagccttcgaggtgtccgaatgaaaaaggatcaacttttaatggatgaaatacaagagttaaatcggaagggaaacctcatacaccaagaaaatgtggaactgtatcagaaggtaaacctaatctgtcaagaaaacatggaattgaaaaagaaggtctatggaacaaaagatgataacaaaacaaacagagattctgttctcacaaatggtctaggcataggagaggatttgcaagtgcctgtgaatctccagctaagccagccacagcaacaacactacaaggaaccttcaggaactacaaaattgggattgcaattgcattgatccatttacaggacgtgtgtttctcaattgctatcaaggaaaatggactcaaattttaacctcaatgttttcatataaatgtggcatatagaccacaaacaaattagcttaaagattttaatttgaaattatcaaaaaaagaaaaggcaaccctatcatgtatgtaagaaacaatgaaagcatcttatgagaaaccaagactcaaatcaaggaagaaattcttc

SEQ ID NO: 344 - DNA, 1015 bp, Glycine max
attcggctcgaggcgctttgtctgttataatcaacgcgctcctcacgagtgaatttctggttcggaaggatctgattgttagggtttggtatggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaagttttggcaaagggaggcagcaatgttaaggcaacaattacacaatttgcaagaaagtcaccgcaggaaaatgatgggggaagaactgtcaggcttgacagtcaaagaattacaaaatttggagaaccaattagaaattagccttcatggtgtccgaatgaaaaaggatcaacttttaatgggtgaaatacaagagctaaatcgaaagggaaacctcatacaccaagaaaatgtggaactgtataagaaggtctatggaacacaagatgataacgaaacaaacagagattctgttctgacaaatggtctaggcataggagaggatttgcaagtgcctgtgaatctccagctaagccagccacagcaacagcaacaacactacaaggcatcttcaggaactacaaaattgggattgcaattgcattgatccatatacaggatgtgtgtgtttcacaattgctatcaagaaaaatggactcagatttaaacctcgatgtcttcgtataaatgttgtggcatatagaccacagactaattggcttaaagattttaatttgaaattattagaaaaagtaaaagcaaccctagcatgtatgtaagaaacaatgaagcatcttatgagaaactaagactcaaatcaaggaagaaattcttcaaaccgcaca

SEQ ID NO: 345 - DNA, 825 bp, Glycine max
atgggaagaaaggccaactgtgacaatcaatatgctatgaacagaggtccttggtctgctgaagaagacaaaattcttatgaactacgttcaagtccatggagaaggaaaatggagagagctttccaaaagagcaggcttgaaaagatgtgggaagagttgtagactccgatggctgaattatctcaagccagatatcaagagaggaaacatttcttcggatgaagaagatctcattattagactgcataagctcttagggaatagatggtctctaattgcgggacgcttaccagggcgaacagacaatgaaattaagaactattggaatacttatttgagaaagaaggcagagcacaagcatgacaaaattcctagccataacgataacattcctatcaaattaagaattgaatctccgggttgctcaaaaaattcctttggtaatgttcttgatcctacaaaatcccctcacccaatgaggtgtaccaaggttatgatgccagtcaatgattcagtcaacacaacgaatttgattacaacgagctgggacaatcataacccttcttctgcatccatgcaactagatgactataatcattgcttaacaggtgtcctccaagaatttgacatcagtgacttgttaatgtcgtatgaggatgattttcgttttaatggatatgcttgtgtcgaaataccccaacatatttttgaagatgagacttgcaggcttgatgattcgttgggtgaagaagcatggtatgagaattggaagaatgacccctattttccacaagatcaagatatgggtttttcttccttttaa

SEQ ID NO: 346 - DNA, 654 bp, Glycine max
gcacgaggaaagagggttagagaaataaaaagagaagaaagaaaacacgatagtatcatcatatcaccaccacacacatagatagagagaggaaaacgacctatattttttttcctttgagagcttcaggggctaggaaaattagaaggacagccacaagtataaaggcggtgaaataaaagagaaagacaagaaggaatcaagcgtggtaacttcacagaacaagaggagaagatgataatccatcttcaagatcttttaggaaacagatgggctgcaatagcttcataccttccacaaagaacagacaatgacataaagaactattggaatacccatttgagaaagaagctgaagaagatgcaagcaggcggtgaaggtggtagctatggagaagggttttcagcctcaagtcaaatccctagaggccagtgggaaagaaggctccaaactgatatccaaatggcaaagagagccctcagtgaagctctgtcaccagagaaaaagccatcttggttatctgcctcaaactcaaacccttcagatagtagcagctccttctcttgcacaagaccgacaacaacacaatctgtgtgctatgcatcaagtgctgacgacatagctagaatgcttaagggtaggatgaagaacccc

SEQ ID NO: 347 - DNA, 1558 bp, Glycine max
cccccccgaaataaaagagaaagacaagaagaagacatgggaacgaccaccttgttgtgacaaagaaggggtcaagaaagggccttggactcctgaagaagacatcatattggtgtcttatattcaggaacatggtcctggaaattggagggcagttcctgccaaaacagggttgtcaagatgcagcaagagttgcagacttagatggacgaattacctgaggccaggaatcaagcgtggtaacttcacagaacaagaggagaagatgataatccatcttcaagatcttttaggaaacaggtacaagtcaatcttccaagcacctacttacttggagttttgtgttcaattcaagcaattaagttactaatgaaatcttttagcttataaaaaagaaaaaaactttgttttgaagatttattttttataactgtttttgagtattttgatttgggaagttctatcttttggatccacatgcttaactggatcacattggttattggtacagatgggctgcaatagcttcataccttccacaaagaacagacaatgacataaagaactattggaatacccatttgagaaagaagctgaagaagatgcaagcaggcggtgaaggtggtagctttggagaagggttttcagcctcaaggcaaatccctagaggccagtgggaaagaaggctccaaactgatatccaaatggcaaagagagccctcagtgaagctctttcaccagagaaaaagccatcttgtttatctgcctcaaactcaaacccttcagatagtagcagctccttctcttccacaaaaccaacaacaacacaatctgtgtgctatgcatcaagtgctgacaacatagctagaatgctcaagggttggatgaagaacccaccaaagtcctcaagaaccaactcgtctatgactcagaactcattcaacaacttagcaggtgctgatactgcttgtagtagtggagcaaagggaccactaagcagtgccgaattgtctgagaataattttgaatccttgtttgattttgatcagtctttggagtcttcaaactctgatcaattctctcagtccttgtctcctgaggccactgttttgcaagatgaaagcaagcctgatattaatattgctgcagaaattatgcccttctctttgcttgagaaatggctccttgatgaggcaggttgccaagagaaattagttggttgttgtggtgatgccaagtttttctaagttgggttcattttgtgacatatgagcctgtgggatttttttattttattttattttatttcataagttataggtagggcctcatcaattaatctcgcttcggccttattagagagagaagttttccagcctttggtgctagacgtgtatatgttaattattattgacattatgatgattattatcatactgtgttagttgccatacactggcaaacttgcttctcttatgtaaagttgatcttgcgacgagatcttgctttatgaattaattgtttttaaagtaaaaaaaaaaaaaaaaaaaaaaaaagg

SEQ ID NO: 348 - DNA, 757 bp, Glycine max
  misc_feature (689)..(689): n is a, c, g, or t
  misc_feature (701)..(701): n is a, c, g, or t
gaaataaaaagagaagaaagaaaacacgatagtatcatcatatcaccaccacacacatagatagagagaggaaaacgacctatattttttttcctttgagagcttcaggggctaggaaaattagaaggacagccacaagtataaaggcggtgaaataaaagagaaagacaagaaggagacatgggaagaccaccttgttgtgacaaagaaggggtcaagaaagggccttggactcctgaagaagacatcatattggtgtcttatattcaggaacatggtcctggaaattggagggcagttcctgccaaaacagggttgtcaagatgcagcaagagttgcagacttagatggacgaattacctgaggccaggaatcaagcgtggtaacttcacagaacaagaggagaagatgataatccatcttcaagatcttttaggaaacagatgggctgcaatagcttcataccttccacaaagaacagacaatgacataaagaactattggaatacccatttgagaaagaagctgaagaagatgcaagcaggcggtgaaggtggtagctttggagaagggttttcagcctcaaggcaaatccctagaggccagtgggaaagaaggctccaaactgatatccaaatggcaaagagagccctcagtgaagctctttcacagagaaaaagccatcttgnttatctgcctcnaactcaaacccttcagatagtagcagctccttctcttcccacaaaccaacaacaac

SEQ ID NO: 349 - DNA, 1079 bp, Glycine max
gagaaattgagaagatgggaagaaaggccaactgtgacaatcaatatgctatgaacagaggtccttggtctgctgaagaagacaaaattcttatgaactacgttcaagtccatggagaaggaaaatggagagagctttccaaaagagcaggcttgaaaagatgtgggaagagttgtagactccgatggctgaattatctcaagccagatatcaagagaggaaacatttcttcggatgaagaagatctcattattagactgcataagctcttagggaatagatggtctctaattgcgggacgcttaccagggcgaacagacaatgaaattaagaactattggaatacttatttgagaaagaaggcagagcacaagcatgacaaaattcctagccataacgataacattcctatcaaattaagaattgaatctccgggttgctcaaaaaattcctttggtaatgttcttgatcctacaaaatcccctcacccaatgaggtgtaccaaggttatgatgccagtcaatgattcagtcaacacaacgaatttgattacaacgagctgggacaatcataacccttcttctgcatccatgcaactagatgactataatcattgcttaacaggtgtcctccaagaatttgacatcagtgacttgttaatgtcgtatgaggatgattttcgttttaatggatatgcttgtgtcgaaataccccaacatatttttgaagatgagacttgcaggcttgatgattcgttgggtgaagaagcatggtatgagaattggaagaatgacccctattttccacaagatcaagatatgggtttttcttccttttaaagtgtttaaaatttaggcacattaccttaaagtgtttttagtattgttctttaatcaaaattagaatttcattttagtatcatgtgcaattaaggttgacatgaaatgttggtactaagatgaaattttaattttgaatcaagaacaggtctaaaatcccttaaagtattgtggctaaatagtctccttttaaaaaactgaacttgaatgaaatggttgaggatgttaaattaacaaaaa

SEQ ID NO: 350 - DNA, 757 bp, Glycine max
actggcaagtgagcctaactttttttttttttttttaacccaaatgaaatacactttcaatgatacaaaccaaaaagattaaattacaaagcattttgtaacataaaaacaaacaaacacacagcgtttacatcacatgatgtaagattgtagggacactcaatttattatgatcagtacaaagacataaggatgactacaatggaaattttgacccagcagcacatgcaccataattaggctttaaattacatatttatcacaacaccaatcatatttatcacacgattcttatcctttcgacttctaaagattcccattggcagacatttgagatttacgaaatctcctctgtttggatagtcgttccgcaaacctcttcaaggcttctccatttgtttcatgagagttaacaggttcgtgaacgccagtctgcaagttaatctttgaaactggtttctttaacaatgactccccaactttcacgagatcattcaaattcttctccgtggccaagtctaccgaagacatgtccccatttaatgaatcgtcctggatacggagatagttatgttcagaattgagtgcttggaaaagggaggtgatgtgaaagtcaaccatgtctgaacttgcatggctaaaggcatcaattaaaggggtgccaccattggttgtagttacccaactaaagatgccccattgagctgcctcatctgcactgtatttcatttccttttgctgagaacccgacagcaac

SEQ ID NO: 351 - DNA, 741 bp, Glycine max
atgggaaggtccccttgctgtgagaaagctcacacaaacaaaggtgcatggactaaagaagaagatgacagactcatatcttatattcgagctcacggcgaaggctgctggcgttcactccccaaagccgccggccttctccggtgcggcaaaagctgccgtctccggtggatcaactacctccgccccgaccttaaaagaggtaactttaccgaagaagaagacgagctcatcatcaaactccacagtctcctcggtaacaagtggtctttgatagctggaagattgccggggagaacagacaatgaaataaagaactattggaacacgcacataagaaggaagcttttgaacagaggaatcgaccctgcaactcataggccactcaacgaagctgcaactgctgcaactgttacaactaatatatcttttggcaaacaacaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaggattgcagctgcaacgtttccaacgctgtcactgtcaacaacaccactccttcttctgctgctgctgctgctgcttatgatttcttgggcatgaaaaccagcggtgtttgggattgcacccgcttggaaatgaaa

SEQ ID NO: 352 - DNA, 744 bp, Glycine max
atgggaaggtccccttgctgtgagaaagctcacacaaacaaaggtgcatggactaaagaagaagatgacagactcatatcttatattcgagctcacggcgaaggctgctggcgttcactccccaaagccgccggtcttctccggtgcggcaaaagctgccgtctccggtggatcaactacctccgccccgaccttaaaagaggtaactttaccgaagaagaagacgagctcatcatcaaactccacagtctcctcggtaacaagtggtctttgatagctggaagattgccggggagaacagacaatgaaataaagaactattggaatacgcacataagaaggaagcttttgaacagaggaatcgaccctgcaactcataggccactcaacgaagctgcaactgctgcaactgttacaactaatatatcttttggcaaacaagaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaagattgcagctgcaacgtttccaacgctgtcactgtcaacaacaccactccttcttctgctgctgctgctgctgcttatgatttcttgggcatgaaaaccagcggtgtttgggattgcacccgcttggaaatgaaatga

SEQ ID NO: 353 - DNA, 744 bp, Glycine max; identical to SEQ ID NO: 352

SEQ ID NO: 354 - DNA, 741 bp, Glycine max
atgggaaggtccccttgctgtgagaaagctcacacaaacaaaggtgcatggactaaagaagaagatgacagactcatatcttatattcgagctcacggcgaaggctgctggcgttcactccccaaagccgccggtcttctccggtgcggcaaaagctgccgtctccggtggatcaactacctccgccccgaccttaaaagaggtaactttaccgaagaagaagacgagctcatcatcaaactccacagtctcctcggtaacaagtggtctttgatagctggaagattgccggggagaacagacaatgaaataaagaactattggaatacgcacataagaaggaagcttttgaacagaggaatcgaccctgcaactcataggccactcaacgaagctgcaactgctgcaactgttacaactaatatatcttttggcaaacaagaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaagattgcagctgcaacgtttccaacgctgtcactgtcaacaacaccactccttcttctgctgctgctgctgctgcttatgatttcttgggcatgaaaaccagcggtgtttgggattgcacccgcttggaaatgaaa

SEQ ID NO: 355 - DNA, 738 bp, Glycine max
atgggaaggtccccttgctgtgagaaagctcacacaaacaaaggtgcatggactaaagaagaagatgacagactcatatcttatattcgagctcacggcgaaggctgctggcgttcactccccaaagccgccggtcttctccggtgcggcaaaagctgccgtctccggtggatcaactacctccgccccgaccttaaaagaggtaactttaccgaagaagaagacgagctcatcatcaaactccacagtctcctcggtaacaagtggtctttgatagctggaagattgccggggagaacagacaatgaaataaagaactattggaatacgcacataagaaggaagcttttgaacagaggaatcgaccctgcaactcataggccactcaacgaagctgcaactgctgcaactgttacaactaatatatcttttggcaaacaagaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaagattgcagctgcaacgtttccaacgctgtcactgtcaacaacaccactccttcttctgctgctgctgctgcttatgatttcttgggcatgaaaaccagcggtgtttgggattgcacccgcttggaaatgaaa

SEQ ID NO: 356 - DNA, 397 bp, Glycine max
ctaaactacttgcgtcccgatgttcgtcgcggaaatataacactccaagaacagataactattctggagctccactctcgctggggcaataggtggtcgaaaattgctcggcatcttccgggtagaacagacaacgaaataaagaattattggaggacccgagtgattaagcaagcaaggaacctcaagtgtgacgtggacagtaaacagttccaagatgccttgcgttacgtctggatgccccgtttgatagagcggactcacccttcactaccaataccatcggaaactcacggcccggcccatgttgacccaaatccaaccgctccggcccaacacgagttgcatggttctggttcgggctcgggtccctctgccttggaggatgtctcatcag

SEQ ID NO: 357 - DNA, 405 bp, Glycine max
aacagatggtcggctattgcggcaaggttgtcagggagaacagacaacgagataaaaaacgtgtggcacacccacttgaagaagaggctgccacaaaattaccaacaaagccatcacactaaaaaacgaagcaaaaaacaaccaccaaagttggatgcggacgcctccaaatccaaccaagacgccaaactagaacaacaagaccccgttaatattcatggatcgaactctgaggacatgatgatgccactatctcctcctcattgttctagcgacatgtcctcctccctcaccaccagtgacaacaatagtaacgttaatattattaataataatcatgatatgtccttaaatgttaatgattatgatattgacaccgaataatcacgaatcggctatagcggc

SEQ ID NO: 358 - DNA, 919 bp, Glycine max
attcggctcgagttgcggctgagttaccaggaagaacagataacgaaataaagaaccattggcacaccacactcaagaagaggtctcaacaaaacacactcacaaaggaagaagctagagcctccaaatcaaaggataaggtacttcccaacaagggtgttactgttactcttccagctacttcttcccagatttcagataattcatcattatcgccagcttcatccaccagcagcgagttttccaacataacttcagatccttccactgctgccagcatgcaaaatttggtgtttgaagatgatgatgagttcggttttctggattcatacattgatcctatgaataatgaaagtttctggaaagagctaactctggatgacatttcctttaataatgtaccaatagtttcagaagataccaatggctgttttcaaagtacaagttctagcaatagcaacacccttgattctctgcataaatcaaccagcgaaagtattgttgcggataatgactttggcggctttttcgatgcatacgcagaagcaaccgttgacaacttttggacacaaccatatgtggctggcatgtcctcccacgttccaactgaactacttgctccctccgttgcagaatctgaatattttactccaatatatgatgatctgtggggccaaactcatttgtattattagcttatattctgatatacaaaaaatagtgcttgttcagtttgagagtaactactactattatacacagtcatgaataatgataattattgttacttattgcaggtgtgtattagtcgggttaataaacgagagtgtatatatatataaataaagtatgtatattgaagttgctttagggtaataatccagcctatatgtaaatttggtttgcaatacaaaaaaaa

SEQ ID NO: 359 - DNA, 1396 bp, Glycine max
caacggccactctctctctttaacctgcctcaccaactcgcatctagaagcaattatagggtctttctctcttctctctctatgttctgtcccctctactttggagtcaaaagcctataaaaccacacccaaacttcctcttgagccggcttcttaatttgttgctgcaagccaatcctaattcctattctcctatccttttacataactctaaagtaagaaaaaatagagcaatttcacaacacaactcttagaattgtgagttaagtatgggaaggtccccttgctgtgagaaagctcacacaaacaaaggtgcatggactaaagaagaagatgacagactcatatcttatattcgagctcacggcgaaggctgctggcgttcactccccaaagccgccggtcttctccggtgcggcaaaagctgccgtctccggtggatcaactacctccgccccgaccttaaaagaggtaactttaccgaagaagaagacgagctcatcatcaaactccacagtctcctcggtaacaaggcatatataccaaactcctcgttaatttcaccatcatatcaattgattcaaaagaaatcttatctctttatcttatctaaattaaaacaaacaaaacaacaacgttgttgttgttgtggtttcaggtggtctttgatagctggaagattgccggggagaacagacaatgaaataaagaactattggaatacgcacataagaaggaagcttttgaacagaggaatcgaccctgcaactcataggccactcaacgaagctgcaactgctgcaactgttacaactaatatatcttttggcaaacaagaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaagattgcagctgcaacgtttccaacgctgtcactgttactgtcagcaacaccactccttcttctgctgctgctgctgctgctgctgcttatgatttcttgggcatgaaaaccaacggtgtttgggattgcacccgcttggaaatgaaatgaaaattcaacgaaattataccaattagttagtgtttttggagagaagtcgagagaatgaaattcgtttatttttgaattttctctcctattttttcttttttttcttctcttatttgtataaataattagtcgctgatatgcataatatatagtaacggtacagttgaacattttattgcccaattttcccttttgttgttactcttcactttcttttcttccggcaattgatggtagtcataaag

SEQ ID NO: 360 - DNA, 760 bp, Glycine max
tttctataaaggtagagagaagagaggacccttctcttgcatagttcaagtgagtgagagtgccaaaaaatgggaagggctccttgttgttccaaagtggggttgcacaaaggtccatggactcctaaagaagatgcattgcttaccaagtatatccaagctcatggagaaggccaatggaaatcactacccaaaaaagcaggtaattaaggttttagatgctcaactttcccaattcatttctcaatttgatgtctcatgttctggtttcgatcacaaattattatgtgtaacttttataataattatattaatattgatatatgattgaatgacagtatataattatatgtgtataatcattaaattcataatataaaattacatgtatcttttatccgaaaaattatgctggagtcggatagaataaattctgattcataactctgaatatacagggcttcttagatgtggaaaaagttgtagattgagatggatgaactatctgagaccagacataaagagagggaacatagcaccagaagaagatgatcttataatcagaatgcattcacttttgggaaacagatggtccctcatagcaggaaggttaccagggagaacagacaatgaaataaagaactactggaacacccatctaagcaaaaagctgaaaattcaaggaacagaagacacagacacacacaaaatgttagagaatcctcaagaagaggctgcaagtgatggtggcaacaacaac

SEQ ID NO: 361 - DNA, 1595 bp, Glycine max
ccagtgaattgttatacgactccctataggggcgaatggggtacccggccccccccctggaggtcagctacgtaggccccccccccggcaaatccaagcacagatgagtttgatcctcaaatctctttatataatgaccttcactagaatcagccaaaccaaaactattacctctctctgacacaagaattaagttgtgagatggagagaagtagtgaagaggagatgttaataacgaaaggtccatggacagagcaagaggattctcttctcttcaattacatcactgtccacggcgaaggtcactggaactctgtcgctcgctacacaggtctaaaacgaacgggcaaaagctgcagattaagatggttgaactacttgcgtccaaatgttcgacgtgggaacataaccctccaagaacagctcttgattcttgacctccattcccgttggggcaacaggtggtcgaaaatagctgaacatttaccgggaagaacagacaacgagataaagaattattggagaacgagagtggtaaagcaggctaagcaactaaaatgtgatgtgaacagcaagcaattcagggacacgttgcgttttgtgtggatgccacgtatgctagagcggattcgggctcaggcctcatcatcggcccaagcccaccaaagcagcttaatctccaacagtaacactcaagcacacagtggattgttgtcatcagcgcttcatgcccacgcgccttctctctctgactcgagcgcgtcgtacaatcttatgggtgctgatgctggaagttgctcatctcatagctactactcagacatagcaggcaatggttttggtggtgcggacttgtggacggatcaaaacatttgctttctgcaacaccagcttgctcatcatgacttgttctgatcatgcatacttcaacatcttgctccaaaattcactctaaactgcaacatataaagcaattgtaacactagtcgtgaaacatgcatgtttctttttatgttaatttggtgtgaaatttaataatctatacttcaattaatttcaagagaactgccatttgttgttagttaagcgtgatttgtacgagatagtgatgagtatttttcgcttaactaagacaattaattttgttcgaaacaaatagaactgataataagaaagtaacaaaacgtgattcgcacaaatcatacaaatgcatgtgatgagtttgtatttggccggaaacaagcagatgataaataaatataataattttttttttaaaaaaaagaaaaaaaaaaaaaaaaaagaattcctgcagctgtttaaacacaataaagtgggatagggggggccccccccccgcgggcgaccattccagctttttgttccctttttgtgggggttggtttccgttgcgtgcttggacgtagtctggttgcccgggttgcttgtgcccaggtgggtgttccgttgttaacccccgctcacaatacgaccccgaaaactaaaagtggaaaacccctggggggggcctaaggggggggccaacccccactttaattgggggtggggtccacgtgccccttttccaaggggaa

SEQ ID NO: 362 - DNA, 2130 bp, Glycine max
cccacgcgtccgtacagctgcgagaagacgacagaagggggagcgtgagcacgaggccagaccaaatcaaagttattttagtacaaagaaaaggagacacattattattgtgtggcagtgcagtgaccgaccatgacgagaactccttgttgtgagagaatgggattgaagaagggaccttggactgctgaagaagatcagatattggtttctcatattcaacgatatggccatggaaactggcgtgcgcttcctaaacaagctggtttgttaaggtgtggcaagagttgtaggcttcgttggataaattacttgaggccagatattaaacgagggaaattcagcaaggaagaagaggataccatcctaaagctacatggaattcttggaaacagatggtctgctatagcggcaagtttgcccggaagaacagacaacgaaataaagaatttttggcatacccatttgaagaagaggatccagaaaagtggagtgcacaatggcaatccttcctcacgtatcttgcaagaggcacaagcaaatactagttcgaatgcatcaagtgtaatgattgccaattacggtttaccctcaaggaatattaatccacctattgcaggattttacggtgcagtctcctcagatacttttggagaaattaaggacaatcatggttcttgtcagctcagtgaagaaatggaattttggtacaatatatattcatcaaatcagggcaaacatcatgagacaatggaaatctaggatattatatagctagattgcatgagatactacatataatttgtctcactcctacaaattaactttttatttttatttttagatatcaacctttaattggtttcagcttggtgtttgtgtacaaaacttaaaatccattttggcaaagcaaattgccagatgaaaactaaagatgatcgatggataatttttaaataaaggctcgagagaagtttgtaaatgcatatatactgaaacaaagtacttttgactgccattttttttggtagtgacttttgactgttatttgaggcaaaggcaaacttttccttcaactttaaacttcaattcaattatgtagttcttagttcttaggaatcattgcaattacaattattatttttgaaaacttttttctgtttttaaaaataaaaatagaaaaaagaaacagtgataataattttttaaagtattttccagtataacatcttctttttaaaaaataattaatattctactttcaatattttatcatttatatttttccaattcagtatcttatcttttttgctttttatttctattctaaaaaaaattgtctttttaattacaaaaataatacatacacttattgtgtactttaccaataaaaaaaaccttactgtgtaattttttctaatgttgacaatacttgcctattattaaattctttttaaaactgaagaatcgaagtaaaatctaacacggcttgccgaataatattaaactcttaaaaaataacaagtcttaaaatagattgactgtactgcacagtggtgatattaaacactttgttttttttatgataatataataatggcccgttgatgtcgctttatgattactatgttagtttcaaatgttttccacagtaggaaaattattttggttgtaggatataccgtaagacttcctcctacactggattattctttttctttttaaaaaaaaaacaatgttttcctttcctattatgcaaatcaagttcactgtctcccttggttccatcaagcttcttcctttgcttcccacagtgtcatgacctcgtctacaagaagctgtcgttggtgtcaaaaagctctccatggatgcctactagggctttttttgggttcaccacggaaatcaaaatatcctgagtaaactccaccacaccaagatcgcataagtgttttttttttcagtttagtttttatatattttaatttattttattatgttcttaaaaaaaattatattgatgcttgtaatttaatttgggatctggtgaatatatggtgatgtttgtaatttaattttagatgttggtgaataaattgtggcttatttaaaaaaaaaaaaaaaaaaaag

SEQ ID NO: 363 - DNA, 1186 bp, Glycine max
ggaatcaactttggtgtatctcgagccgcaagagagagctagcagtgcaagctttcaacatccaaaacaacagagagtttttggctttagaagctgaaggaatatagttatcacaatggggagagctccatgctgtgagaaaatggggttgaagagagggccatggactccagaagaagatcaaattctcatcaattacatcaacacttatggccatgctaattggcgtgcactgcccaaactagctgggctattaaggtgtggaaagagttgtagactccggtggataaattatctgagaccggacatcaaacggggcaactttaccagagaagaagaggacactataatcagtttgcatgaaatgttgggaaacagatggtcggctattgcggcaaggttgtcagggagaacagacaacgagataaaaaacgtgtggcacacccacttgaagaagaggctgccacaaaattaccaacaaagccatcacactaaaaaacgaagcaaaaaacaaccaccaaagttggatgcggacgcctccaaatccaaccaagacgccaaactagaacaacaagaccccgttaatattcatggatcgaactctgaggacatgatgatgccactatctcctcctcattgttctagcgacatgtcctcctccctcaccaccagtgacaacaatagtaacgttaatattattaataataatcatgatatgtccttaaatgttaatgattatgatatcgacacgccggagaataatctcttgcattggacgaggatttctggtcggaagtgttgtcgtctgataattccggtgagacaacaagcggatttccgaccattgactatgatcatcagtttctaccgatgtctcctctaatgaccgaagaaggggtccttatagatgctagttcgtcgagtgtgtgcgacgacggcatggacttttggtgcaatgtttatgccagagctgaggaatttacgcagttattggaattgtgatgttagttaatgttgctcttaattagtagagaccaagtccttcattcaacggaaaacaaaagatcatgtcattgttcttctattgtttggacttgaattaatttcctagatagaaattaataaagtgtgtccattacgactgttactcgatgtgattataataaaggtgtgtgtgttcattact

SEQ ID NO: 364 - DNA, 1916 bp, Glycine max
ccacgcgtccgcggacgcgtgggttgcagagaaacacaaacactgaaacactcaagtgagttcgatagtatatttgtttttctttttcacaaagatggtgagaaccccgtcttgtgacaaaagtggaatgaggaaaggtacttggactccagaggaagatatgaagttaattgcttatgtcactaggtatggctgctggaattggcgccaactccccaagtttgcaggtcttgcaagatgtgggaaaagttgtagattgagatggatgaattatctaaggcctaatatcaaaagagggaacttcactcaacaggaagaagaatgcatcatcagaatgcacaaaaaacttggtaacagatggtctgctattgcggttgagttaccaggaagaacagataacgaaataaaaaatcattggcacaccgcactcaagaagaggtctcaacaaaacacactcataaatgaagaaaccaaagccatcaaatcaaagaataaagaatcagttcacaacaacggtgtatttgttactcttccagcaacttctcagatttcagataattcatcattatcgccagtttcatccacctgcagcgagttttcctccataacttctgatctttccactgctgccagctgtatggaaaatttggtgtttgaagatgatgacttgggttttctggatttatacaatattgatcctatgaatggaaatttgtggacagaactaaatctcgatggcatttccttcaatacaccatgtgaaatagtttcaggagatactaatagcactttccaaagctcaagttctagcaatagcaacacccttgattctccgcatcaatcaaccagcgaaagtattgttgtgaataatgactttggtcgctttctcgattcatacgaagaggcaacagtcgataacttttggacacagtcatatgtagctgacatgtcccacgttccaagcgaactatttgttccctccgtggcagaatctgaatattttactccattatatgatgatctgtggggtcaaactcatttgtaccatgaaaatcattgcttattctgatgaacaaaattactccatctctagagatcaatagttttgagagtgttattagagttggtgattccaattcttgatccaacctagatggatgaatctttttatatttttggcttaggggtttgtatagtattgtagcagttgctctcctatatttctcttgtaccaattttttataaagtgaattgcttctgctttggccaggtagtggacccatggatcgagtcagctacgtaggccccccccccccgtacttgcagctgctgatacatctaattctaaagaagaagaaaagctagccattgaaaagattatgtccggtccgtatgatgcacatcaagcctttccagaagaacctgaagagcttgaagacgatactcagtataaaaatcaagacaaagattctggtgggaacatgaaaaacaacatggaatctttactctcaaagcctgcagtggcagaagagccagttatttctaaggaaattacttgttcaactcatttattctccaatgagatcttggaggagcttgagcctgctgagctatcagcaccattgttaagtgggcctcctgcacctttaccaatgaagaagccgcttatcaggttgaacttcacctccttaggcaaagctgctgacaaaagtgcttaagctgcaactagctgatttatgtaaaattgacatttctagttccttgtttatttatgtaataattatgatgcagtaaataaacctgagctagaaaagccatcaattttcattgatatgtacatgagaatatgttgcaccggcaaaataaaacagattttgatgagttaaaaaaaaaaaaagaaaaaaaaaaaaaaaaaa

SEQ ID NO: 365 - DNA, 520 bp, Glycine max
acaatgaacttagaagagggccttggactcttgaagaggataatttgctctcccaatatatttctagtcatggagaagggcgatggaatttgctagctaaacgttcaggattaaagcgaactgggaaaagttgcagattaaggtggctaaattatctaaagccagatgtaaaacggggaaatttaaccccacaagagcaacttataatcctcgaactccactcaaagtggggaaacagacaaatgcgaccaatgcagccttgaaacggtcacaaagactctcaaagccttaaggtcgcggccaaaatcgtgatcacatactgttttttaaaacctgcctcttcaaaatgctggtggtcaaaaattgcacaaaatttgccaggcagaacagacaatgaaatcaagaactattggagaactaggattcagaaacaagcaagacatttgaaaattgacactgacagcagagagtttcaggaacttgttaggcgtttctggatgcctagattgcttcaaaaagc

SEQ ID NO: 366 - DNA, 1317 bp, Glycine max
  misc_feature (27)..(27): n is a, c, g, or t
ttactaagggagtggtctcccggtccnggaaggacactaccaccccaccccgggtcggtctttcgattgaaagggaagggaccgatctcgggctcggcggataggataagaaaatgagctgcttaaacataacttgaacgtgaatctaacataaacgcttacgatttcactttcccttttccgttctggcaactcatgtgaagggaagtcggatcgggcctgtcctctactctaccacgcgaccaaagggggatgtgatgcaatgcgattcgattaggttgggtcagggttttgcctttccagtcgttgtgaagtgaagggccgtccattgtgatcgcgtcatccgtatcgcgaatagggggaccggggcccccctgccccccctcgacgtaggcccccccccccccggagtgagaatagccatgtctacttcaaagagcgtcagcagttctagtgaagatgacaatgaacttagaagagggccttggactcttgaagaggataatttgctctcccaatatatttctagtcatggagaagggcgatggaatttgctagctaaacgttcaggattaaagcgaactgggaaaagttgcagattaaggtggctaaattatctaaagccagatgtaaaacggggaaatttaaccccacaagagcaacttataatcctcgaactccactcaaagtggggaaacaggtgcttatcttgtgcatttgattcttgagctccacaggttttaaattgtggtccaggttgtgcttacagtcggcgttttatcgcgatttctttgtattgtgagaaattgtagacaaatgcgaccaatgcagccttgaaacggtcacaaagactctcaaagccttgaggtcgcggccaaaatcgtgatcacatactgttttttaaaacctgcctcttcaaaatgctggtagaagcaaagatgcaaatcttgccactatcaacaagcatgctttccattccaaaatattgtcttttctctggattttcatttctttctttaatgactgtaggtggtcaaaaattgcacaaaatttgccaggcagaacagacaatgaaatcaagaactattggagaactaggattcagaaacaggcaagacatttgaaaattgacactgacagcagagagtttcaggaacttgttaggcgtttctggatgcctagattgcttcaaaaagccaaagaatcatcttcttcagccatgtcaattcaaaaccaggcaactcctatgccttttgatggtgtttctcagcattcaactgttgggaccataccatcacattcacacaccccttggca

SEQ ID NO: 367 - DNA, 465 bp, Glycine max
  misc_feature (340)..(340): n is a, c, g, or t
  misc_feature (360)..(360): n is a, c, g, or t
ttcgggtcatgagggaagaaaatctctagctgtgccacacttttgggaagaaacacacaaacccattattcgtattactcacaaaagtggtaaaggaacaaaggaaacaccgattaattattgttgtggagattgatgatggtgagaaccccgagctgtgacaaaaatggagtgaagaaaggaacatggacaccagaggaagacaagaagttggttgagtacattaccagatatggccactggaattggcgattactccccaagttcgcaggtcttgcgagatgtggaaagagttgcagactaaggtggctgaattacttaaggccaaacctcaaaaganggaactacaccaaggaagangaggaaactattatcaagctgcacagacatctgggtaacagatggtctgccatagctgcacggatgccaggaagaacagacaacgaaattaagaaccactggcac

SEQ ID NO: 368 - DNA, 899 bp, Glycine max
ccaaagagatcaacaaaggtgcttggtctcgagaggaagatgaaaccctctccaaatatgtttccatccatggagaaggaaaatggcagaaggttgcccaaaatgcaggtttaaagagatgcggaaaaagttgcagacaaagatggttgaattatctcaagcccggcataaaaagaggccacatctctgttgatgaagagtttatgattataagacttcatcgtcttcttggtaacagatgggcattgattgcaaagaggctacctggacgaacagacaatgaaatcaagaactactggaacactaatctgtcaaggaagttacagaaacatcctacatcatcagtttcttcacttcaacacaaacgtcatgaaaaggaaaagaccaaacaaatgcatgtagcacccgaagctccacggcgtaggagggttaatgcagttgaatacagtaaaaatttggagaatggtgggtgtggaaataggcctagtacaactcccagtccctcaaatatagaagagggtagtagtgaagaagcttcttttagtgattttctcatggatattgatcaaattgatgattcaaactcaaaggtcccacaaaaggaagaggatcaccaccacaacaaggtagagttaataaccaacaacagtcctagctcttcatcactttctgatcattgtcaccatctcttgccagagaaatttgacccttttgagacctttctggatgtggagcttcagaggatggcttcctttcttggagttgaaaatgattgatcaagagattttatttattgcatgcagtgaaaaaggtcaagtacacttggggagtgttatagataatatgccatctatatatggaatgcctaattaactaagcatctagctctagctagatgt

SEQ ID NO: 369 - DNA, 1511 bp, Glycine max
ccacgcgtccgaaatccccgcatttgatccaggcaataaaaggccaatgagggaacaaaagctcgggattcggctcgaagaagaagacccttgcacgcacatagcttcaaagaaattaattaagatgggtcaccattcttgctgcaaccaacagaaggttaagagaggcctttggtcccccgaggaagatgagaagctcatcagatacattaccactcacggctatggttgctggagtgaagttccagagaaagctgggcttcaaaggtgtggtaagagttgtcgcctgagatggattaattatttgaggcctgatattagaagaggcaggtttacacctgaagaggagaagttaattataagtcttcacggggtcgttggcaacagatgggctcacattgcaagccacttaccaggtagaactgacaacgaaataaagaactactggaattcttggatcaaaaagaaaattagaaagccttcttcggtgacttcatcaatgaccactacacaaagtgttgatcataccacccccaattcaattttaattccaatcaactagatcactatggcaaccaagaaaatttaacagcaaagccaccgatgcaagaaaccttattttcctcgacgtgccccctatttatgtttgacactagttcattagatcaagggacaacaacagtagacaccaccaccaatgtacgagcagaattgttccaagattcattgggtttgagcagtagtgaaacgtggaacatgagccaccatcaagtccatgctcttcctcctcaactagcagcaacttttacagcagcaacagttattgatactacgaattatctgccaccattgatagagaacgttgaaaacatggtgccaaatatggaagtacagtcttgtagtatagacgaggaaggagaaatggcactagagtgtttgcggagacaagatttgaatgagtgggtggagaatcaacaacaatgtcccagctttcttttctgggacaatattaatgttgaaggacaacttcgaggggaagaactagcaccaaacacgtcaaatatgggaaacaatacactttcaccttttccttcctctttatgactgcaacaaggactgtccccactccccactatactctttttctcatgctccctctaaccaggaagagttttcaggaatggtccggcccaggctgaaacttatattgcagagattgctttttcttcttttgttttttttccaacctctttcgattgctgattggaaagattcagaaaaatgagtgaagataagatatgttatatatatataaccaagcgtgatgggtttattactttttattgagtgttttgacatggaagagggaaaaaaaaaagagaaggaataataataaaggcgattgtaacccgaaggaaagtttgattttgaagatatatatggaaagcatcttcaatttgcttgttttttgactgtaaaaatggtgggttttgaatgagaataaataatgg

SEQ ID NO: 370 - DNA, 1138 bp, Glycine max
gggtgttttgagttttgatcaatgagactagccatgtctactccttccaagagcataatctgttcaagtgaagatgattatgaacttagaagagggccatggagtgttgaagaggattatcttctcacccattacattgccaatcatggtgaagggagatggaatttgctagctatacgttcaggactaaggagaacaggtaagagttgcagattgagatggctcaattatctaaagccaaatgttaagagaggaaatttaacctcggaagagcagcttttgatttttgaactacactcaaagtggggcaacaggtggtcaaaaattgcgcaacagctgccaggcagaacagacaatgaaatcaagaactattggagaacaaggattcagaaacaagcaatatatgcgaaatttgaggatcacagaagagcaggatttgtagaatttgtcaagggtctacagatgacaagatgtcttcataaatcacaagaatcatctccttcggccatgtcaacccaagaccaagcaattcctttaccttttgatggtgttactgttcctcattattcatcatttgggattgggacaacaccaacaatacaaatcacttgccatggagatctcaatcatttgaatcagcatgagcagaactcagactctgaacaccacaatagttcatgcatttcctcttcagaatcagcaaatatcccaaatatgagtcagccttttggatacactactagtcaatttcaggccttagataactgtgactttggcatgtgtttatatgatggctatagcatagataacaattcctatgacagggatgccttgaacctgacaaccacaatggttgctgggaatctggaactcccagtgtttgattgccaaacattagaaaccaataggctaaacaaggaatttgcaagtagcacatggagcatggatgaattatgacaatttaggaacatacaaagattatcatttagattctagagtatctttttagaaccactcactatctcttttataatatgtagtgcttgtcattagataatcgattattcaatagcttagctataaatataaatgtaaagactaaagagtagttgttttataatttataggacatttgggc

SEQ ID NO: 371 - DNA, 1085 bp, Glycine max
attcggctcgaggcaagccaatcctaattcctattctcctatccttttacataactctaaagtaagaaaaaatagagcaatttcacaacacaactcttagaattgtgagttaagtatgggaaggtccccttgctgtgagaaagctcacacaaacaaaggtgcatggactaaagaagaagatgacagactcatatcttatattcgagctcacggagaaggctgctggcgttcactccccaaagccgccggccttctccggtgcggcaagagctgccgtctccggtggatcaactacctccgccccgacctcaaaagaggtaactttaccgaagaagaagatgaactcatcatcaaactccacagtctcctcggtaacaagtggtctttgatagctggaagattgccggggagaacagacaatgaaataaagaattattggaacacgcacataagaaggaagcttttgaacagaggaatcgaccctgctactcataggccactcaacgaagctgcttctgctgcaactgttacaactgccaccactaatatatcttttgggaaacaacaagaacaagagacaagttctagtaacggaagcgttgttaaaggttccatcttgtaacgctgccctgacttgaaccttgagttaaccattagtcctcctcgccaacaacaacctcagaagaatctttgttttgtttgcagtttgggtttgaacaacagcaaggattgtagctgcaacgttgccaacactgttactgttactgtcagcaacactactccttcttctgctgctgctgctgctgctgctgcttatgatttcttgggcatgaaaaccaacggtgtttgggattgcacccgcttggaaatgaaatgaaaattcaacgaaattataccaattagttagtgtttttggagagaagtcgagagaatgaaattcattaattttttaattttcccccctattttctttttcttctcttgtttgtataaataattagtcgctgatgcataatatatagtaccggtacagttgaacattttattgcccaattttcccttttgttgttactcttcactttctt

SEQ ID NO: 372 - DNA, 941 bp, Glycine max
ttgatcccctgtatatataaacactcttcctctcctccaaattaaaacacttatcatggatgttaagaaaggtgggtctgtagtacaagcacaagtgaagttgcagaagcataacgaaaaggagatgggcatgagaaaaggtccatgggcggttgaggaggacaccattctggtcaattacatcgccacacacggtgaaggccactggaattccgtggcacgatgtgcaggtctaaggaggagtgggaagagttgcagattaaggtggctaaactacttgcgcccagacgtgcggcgtggaaatatcacactccaagaacaaatattaattctcgaccttcactctcgctggggcaacaggtggtcaaagattgctcaacagctgccaggaagaacagacaacgaaataaagaactattggaggaccagagtgataaaacaagcgaagcagctaaagtgcgatgtgaatagcaaacagttcagagacacgttgcgttacgtttggatgccgcgcttgctggagcggcttcagcccacatcacaagcactggagccaaaccaaagtggacttgtgttacacgcttcatcatcactgcttccttcgaattccgaccatagtattgaaagggggtcggatctgtggccaggtttcaataaccaaatgttgttggaacaggggagtggcggtgacttgttggaaagtttgtgggatgacgacaatatgtgctttttgcaacagctttcttatgacctccaaatgaaataaaatacaattcccttccgtcacgcattctgcaatgcacagtgctgaaagttgagcatgcgttcaatgaatattgttttcctcactttcatgtacatattaaatcttagagactaaactagtcacgtgcctaaaagttgataccagttgaaataatatggtttattaatcttaattg

SEQ ID NO: 373 - DNA, 562 bp, Glycine max
cagcatttgatcaaggcaatacaaggccacttagggaacaagaatataaaagaaggaaaaagaagaagacgacatagcaaagcctagaaacatgggtcaccattcttgctgcaaccaacagaaggttaaaagaggactttggtctcctgaggaagatgaaaagctcatcagatacattactactcatggatatggctgttggagtgaagttccagaaaaagctgggcttcaaaggtgtggcaagagttgtcgcttgagatggattaattatttaagacccgatattagaagagggaggtttacacctgaggaggagaagttaattataagccttcacggggtcgtaggaaacagatgggctcacattgcaagccacttgccaggtcgaactgacaatgaaataaagaactattggaactcatggataaaaaagaaaataagaaagacttcttcggtgtcttcaacaaccattgcacaaagtatcgatcacaattcttctgaccagttcaattacaattctaatctaatactataccactttcccaaccatgataacaatcta

SEQ ID NO: 374 - DNA, 1490 bp, Glycine max
ccacgcgtccgtacggctgcgagaagacgacagaagggcaattatttaaggcctgatttaaaaagaggaacattctcacaagaagaagaaaaccttatcattgaacttcatgcagtattagggaacaggtaattgtaattgtaattttaattcagtctctctcatgattgaattaatgaattctctccctttttcttttctactgtggttaacatttatttttctttttcatttgcttgacatgcatattattatcctgtgctgtctcaggtggtctcaaattgcggcacagttgccggggagaacagacaatgaaataaagaatctgtggaactcttgcttgaagaagaaactgaggcaaaagggaatagaccctgtcacacataaaccactgtctgaggttgagaatggagagaaagcagcagaagtgtctaatgaactgaacctcctgaaatcagagagctccaagtctgattcagcatcctatgagcagagaacatcaatttctccaaaagcctatgcacctgagatggatggttcctgcagctccaagattgaaatcaattttgtaaccaacaacaactgttacaacaaagacttgttcctagacaggtttatgagtagtagccgccaagagagttacaccactagttgccagccctcagatttgatggggaattttccaattcagatgagttatgcaaccaatgatcagtgtctccctaatgattcaaactctagtcattggttcagccaaactggaaggtcttttgatatgaacactgagtttcctttcaatgccgctgtcacttctatcaatcctacacctacaaccaacttgtttcttcctaataattctttttgctacaagccttcacttgctgttccctctgacaatgtttccataccctatggatcccattactgggaagccagtgcctccaacaacagcaatagcagcattaggagtaatagcagcacagaattgagaagtagcagccccttgaacatcttttcttcttggggattggcagattgtggcacctctactactaaagaggcacaaattcatatgatggagaatcataatacagaagaagctaagtgggatgagtaccttcataaccctatctcaatgctggcttcttctgtacaaaaccaagctcctgagtctctatgcaatgatataaaaacatccatgcatttggtacctgatactttaggggctatgttacctcataaccataccaagcagcaagaacagtctcaaacttctagtttcttttccaaggacatccagaagctcagggcagcctttggacacatgtaaaaggattggagagaaaaacacagattttagaaagggttccaattcaagggattgctattcttagtacaggtgtgtgaaaccacagattttttgctcttgtatgtaggtctaatacaaaacatttatttacaaaaaaaaaaaaaaaaaaaaaaaaaaaaaa

SEQ ID NO: 375 - DNA, 1495 bp, Glycine max
ccgtaaggggggggagactcatttcgattggacagcgagggaattggggtcgagtttaagtcctgcatatatatgcgtagttttttttatagttttagggagtgagaatagccatgtctacttcaaagagcgtcagcagttctagtgaagatgacaatgaacttagaagagggccttggactcttgaagaggataatttgctctcccaatatatttctagtcatggagaagggcgatggaatttgctagctaaacgttcaggattaaagcgaactgggaaaagttgcagattaaggtggctaaattatctaaagccagatgtaaaacggggaaatttaaccccacaagagcaacttataatcctcgaactccactcaaagtggggaaacaggtggtcaaaaattgcacaaaatttgccaggcagaacagacaatgaaatcaagaactattggagaactaggattcagaaacaggcaagacatttgaaaattgacactgacagcagagagtttcaggaacttgttaggcgtttctggatgcctagattgcttcaaaaagccaaagaatcatcttcttcagccatgtcaattcaaaaccaggcaactcctatgccttttgatggtgtttctcagcattcaactgttgggaccataccatcacattcacacaccccttggcagggaccttgtatgaatgaagctggtcccacttacatggaccaacatgagcagaactcagactctgaacacaacaatggttcatgcatctccttgtctgagtcagcaaattttccaaaagtgcctcagcattttggacgcaccaccatcacccaatatcatgccttgaataacaatgactttggcaccttcacatatgacggctacaatgtaagcaacaatgtctatgagatggacaacttcaaaacgcctactacaagggtggctgaggatgcgcaatacccaactggtgattgtcaaatggtaggaagcaattgggtaaacagcgattttgcatgtaacatgtggaacatggatgaattgtggcaatttagcaagttacaaaaataagattttagggtttggtttttttggagttaccaagactctatctttggtgatgttattattgttatcatgaactgttgattagctactaccaaattaattaatacagatggtgattgttttctgtacatctgttttgcattactctgttttgcaatttgtattgattgagaaaagtcattaattagtcactagttcaaaacacaaacagttggagattgagtgctaataaagatttcgtaaatatatagaagtaaacacttttagaaactttggtgcatttgtaggggaaatcggaatgccgaatgcagccactatgatatctaaatgaagagggcccgtgattgaatgaggatttaattggagatgaaagtagaaagctgcaaaatgactcatagcgtgtttgcttatccattcacgacgtagatttc

SEQ ID NO: 376 - DNA, 1664 bp, Glycine max
ccacgcgtccgaaaaattacaaagcacgagggtctcgtttagcaacttgtaaaggacacaacagcatcacttacataacatgcacttccccttctccaccgcattctgtgttctctagtcaatagaaagtgagcactgaatttgctttgtgccgttcctgttttcttataatttgtgcatttttttgcacataaacaaaacccatgggaagggctccttgttgtgagaaagtgggattgaagaaggggaggtggacagcagaggaggatgagatcttggcaaaatacattcaggccaatggggaaggttcttggaggtcattgcctaaaaatgcaggattattaaggtgtgggaagagttgcaggctgagatggattaactatttgagagctgaccttaaaagaggaaacatttctgctgaagaggaaaataccattgttaagttgcacgcttcttttggtaacaggtggtctttgatagcaaatcacttaccaggaagaacagacaacgagataaaaaactactggaattctcacctcagcaggaaaatttacagtttcccaggtgcaggtgcaggtgcaagtgcagggatcatggatacacctaaggtagtatatattcctcccaagcgcaaatgtggtagaacaagtcgttgggccatgaagaaaaacaaaacatacacccaaaaagtcaatgataggattaaccagagacacacacaaattggtttccctcaacagaacagtgacaccgcagttccgacgccaccaactccgtctctagagagtgagggtttgtcaaacgccgttaatgacttcaaggtcctggacggtgacgtggcagagtttgatgagccgagaacggaggagctggaggcggaggtaaataaacgtgacaatagcgttggaggcgtggaagaaagtagtaataccgatgaagacatcttgggactgtgtgaactagagggcattaatgaggacagtgggatgttgttgggttttagtgacattttggaaagttgccttgcggaaacaacatgtggggtttgggacataagtgaagagagagaaagcaatgacgtggtggcggctgatgcttgtcgcgacaaaatagcatcgagtgaggaagggtcatgctcttccatgaatcaagactgggactgggagagcgtgttagagtttagtaacgctgttgataattgggaggaccaagacaaattgctcacttggctgtgggaggacgatgactgcaagagattgggagagacagatactcagatactacaaaacgacatggttattgattggtttctctcttgattcatccaagaataaaataggcttagtgtgtgtgcccccttggtcatgtttctttaatctgttcttcttggattgattagggaatgtgtaaacttaataaatactttttttagttacttatataatcatccttaagacacactagttaggaatactcttttccttttactttaatttgcatgtcacatgattcgaaaatatcatgcagaagaattggaccagacattagtcactgtagcattcctaggttgtttgaaaatatggatcttattatatacgagttagagtttgatttttttataattaatttatagtacataaataaatatagaattttctgtgata

SEQ ID NO: 377 - DNA, 2010 bp, Glycine max
gactacgacccttctcatggggcctcgctcttatattagttcaacttcttttctcagctgccagttcattttccttcttcatatcatctctctcactgtcacatgctctctatctatcccagccactccaatagctttggttcactgccacccctgctgacatttttctcgttggaataaacaaactttgtgttaacttaaaaggtttaagggaaaaagaaaaactacaaaatgggaaggcactcttgttgttacaagcagaagcttaggaagggtctttggtctcctgaggaggatgaaaaacttctgaggcatattactaagtatggtcatggatgttggagttctgtgcctaagcaagcaggtctgcaaaggtgtggtaagagctgcaggcttaggtggatcaattatttaaggcctgatttaaaaagaggaacattctcacaagaagaagaaaaccttatcattgaacttcatgcagtattagggaacaggtggtctcaaattgcggcacagttgccggggagaacagacaatgaaataaagaatctgtggaactcttgcttgaagaagaaactgaggcaaaagggaatagaccctgtcacacataaaccactgtctgaggttgagaatggagagaaagcagcagaagtgtctaatgaactgaacctcctgaaatcagagagctccaagtctgattcagcatcctatgagcagagaacatcaatttctccaaaagcctatgcacctgagatggatggttcctgcagctccaagattgaaatcaattttgtaaccaacaacaactgttacaacaaagacttgttcctagacaggtttatgagtagtagccgccaagagagttacaccactagttgccagccctcagatttgatggggaattttccaattcagatgagttatgcaaccaatgatcagtgtctccctaatgattcaaactctagtcattggttcagccaaactggaaggtcttttgatatgaacactgagtttcctttcaatgccgctgtcacttctatcaatcctacacctacaaccaacttgtttcttcctaataattctttttgctacaagccttcacttgctgttccctctgacaatgtttccataccctatggatcccattactgggaagccagtgcctccaacaacagcaatagtagcacagaattgagaagtagcagccccttgaacatcttttcttcttggggattggcagattgtggcacctctactactaaagaggcacaaattcatatgatggagaatcataatacagaagaagctaagtgggatgagtaccttcataaccctatctcaatgctggcttcttctgtacaaaaccaagctcctgagtctctatgcaatgatataaaaacatccatgcatttggtacctgatactttaggggctatgctacctcataaccataccaagcagcaagaacagtctcaaacttctagtttcttttccaaggacatccagaagctcagggcagcctttggacacatgtaaaaggattttagaaagggttccaattcaagggattgctattcttagtacaggtgtgtgaaaccacagattttttgctcttgtatgtaggtctaatacaaaacatttattttcaccttttgtttttccttcactttgtttaacatttgtgagccaaaaaccatttgtcttttactttcttctttcgggtgtggggtagaattgaagaagaataagggttgctattctgtcttctttctactctttctttgctacactgtaaccgcaatggtgcattttgcatgtccaagttcaaagccatcacagattttaattggtccatgcaaagtttcatttccattttgatgccagggacagagttactttacctgcaaacaattttcagaatcacttttacccggttcccgatatgatcttcttttcccactttcatactactgaaaatgacaccaaactagtgtaaccagcacttttacc

SEQ ID NO: 378 - DNA, 1090 bp, Glycine max
attcggctcgaggtcactttacattggttgctagcaagtggtatggggaggcaaccctgctgtgacaaacttggggtgaagaaaggtccatggactgctgaggaagacaaaaaactcataaacttcattctctccaatggccagtgctgttggcgagctgttcccaagcttgctgggcttcggcgttgtggtaagagttgtcgtcttcgttggactaattatctaaggcctgacttgaagagagggctcctcacacaggctgaagagcagcttgttatcgatctccatgcccgtcttggcaacaggtggtccaagattgctgccaggttaccaggtaggacagacaacgaaattaaaaatcactggaacacccacatcaagaaaaagctccttaagatgggtattgatcctgttactcacgaacctcttaacaaacaagtctcatccaaagatagttcatcccctgcagagcatttctcacaagtgaataacattaacattcatcaggttgagcaaaatgatggggttctcaactcagaagagaattcaacctcatcaccggctgaaaattcttctggggaagaatcccttttggtggatagcatttgcagtgatgtttctctaattaacagcatgtggctggatgaaactcctctgatggacacattatgggacaatacacctaaagttgagaatgcaaataataacatgggcttaccaataggggaggataattgtgcttggttgttggactgccaggactttggtattcatgattttggcttcaattgtttcagcgaggttgaaacaaatgtactgcaagctataggcatggacagaaaagggctttaggatgcagtacatatggtaattaaagttagttgtccttaagaaacagagcatgcaatcaaaaaatatgtgtatatgtgaatgtgacaaaatgggaataaatcctctcgtgtccatgtcacgttcaaattttgtgtttataactttcttgatgaatattagataaagttctccttatttattatttgtcaagaaagtgatacacacgagatttgaacgtgaaaaaaaaaaaaaaaaaagg

SEQ ID NO: 379 - DNA, 1762 bp, Glycine max
cccacgcgtccgctttctataaaggtagagagaagagaggacccttctcttgcatagttcaagtgagtgagagtgccaaaaaatgggaagggctccttgttgttccaaagtggggttgcacaaaggtccatggactcctaaagaagatgcattgcttaccaagtatatccaagctcatggagaaggccaatggaaatcactacccaaaaaagcaggtaattaaggttttagatgctcaactttcccaattcatttctcaatttgatgtctcatgttctggtttcgatcacaaattattatgtgtaacttttataataattatattaatattgatatatgattgaatgacagtatataattatatgtgtataatcattaaattcataatataaaattacatgtatcttttatccgaaaaattatgctggagtcggatagaataaattctgattcataactctgaatatacacactttctttattttctcacgtctccaaaagcttctccctctttctttttttttctatcacgcaaactcatcatttagctatagtagcttaattaagtagctcaacaagttcaaattacaatgggtagatcaccttgttgtaacaaaacaaagcgggggctctgcttcagtacttgctacctttctataaaggtagagagaagagaggacccttctcttgcatagttcaagtgagtgagagtgccaaaaaatgggaagggctccttgttgttccaaagtggggttgcacaaaggtccatggactcctaaagaagatgcattgcttaccaagtatatccaagctcatggagaaggccaatggaaatcactacccaaaaaagcagggcttcttagatgtggaaaaagttgtagattgagatggatgaactatctgagaccagacataaagagagggaacatagcaccagaagaagatgatcttataatcagaatgcattcacttttgggaaacagatggtccctcatagcaggaaggttaccagggagaacagacaatgaaataaagaactactggaacacccatctaagcaaaaagctgaaaattcaaggaacagaagacacagacacacacaaaatgttagagaatcctcaagaagaggctgcaagtgatggtggcaacaacaacaaaaagaagaagaagaagaagaacggtggcaaaaagaacaagcagaagaacaaaggcaaagaaaatgatgagccgccaaagacacaagtttacctaccaaaaccaattagagtgaaggcaatgtatttacaaagaacggatagtaacaccttcacctttgattccaattcagctagtggatcaacaagccaagagaaggaggaaagccccgtgacaaaagaatcaaacgtggttagtgaagttggtaatgtgggagaagaaagtgatggttttggcttcttcagtgaggaccatgacttagtcaacgtctcagatattgaatgccactcttattttcccacagatcatggcaacctacagcaattgtatgaagaatatttccagctcttgaacatggaccatggccaattcgaactgaattcatttgcagaatctttattagattaaaagaatatcaacaaagatttgttcagttcatgaagatcacattgcttacatataaactttgttgatagatcatatgtaaatatatctgtaaatgatctctgagttatgagatcttttttgtctttaataaatatcgccatctaactcaaaaaaaaaaaaa

SEQ ID NO: 380 - DNA, 1133 bp, Glycine max
ttcctaagatgctgatcataattgtaataacaaagaccaatattttgtgtgtgccagtgagctagttaggtgttaaatatttgattgcaatattaatatgaaggcacagtgtgagtagtgagaaggggcattagtaaagaggatgggtagacgaccctgctgccccaaagagatcaacaaaggtgcttggtctcgagaagaagatgaaaccctctccaaatatgtttccatccatggagaaggaaaatggcagaaggttgcccaaaatgcagggttaaagcgatgtggaaagagttgcagacaaagatggttgaattatctcaagcccggtataaaaagaggccacatctctgtggatgaagaggatatgattataagacttcatcgtcttcttggtaacagatgggcattgattgcaaagaggctacctggacgaacagacaatgaaatcaagaactattggaacacaaatctgtcaaagaagttacaaaaacatccaacatcatcagtttcttcacttcaacacaaacgtcatgaaaaagaaaaaaccatacaaatgcatgtatcacccgaagcaccacggcctaggagagttaatgcagttgaatacagtaaaaatttggagaatggtgggtgtggaaatagacctagtacaactcccagtccctcaaataaagtagagggtagtagtgaagaagcttcttttagtgatttcctcatccacgacattgatcaaaaccaatttttgattgctgatgattcaaactcaaaggtgccacaaatggaagaagatcaccaccacaacaacaaggtggaattaataaccaacaacagtcctagctcttcatcaccttctgatcattgtcaccatctcttgccagagaaatttgacccttttgagacccttttggatgtggagctggcttcctttcttggatttgaaaatgattgatcaagagattttatttattattattgcatgcagtgagatgaatgaaaaaaggtcaagtacttagggagtgttatagataatatcccatctatatatggaatgcctaactaattatgcatctagctatagctagatgtaatatacaaatccagggtttctttttcgaaaaaaaaaaaaaaaa

SEQ ID NO: 381 - DNA, 1133 bp, Glycine max
attcggctcgagctctgacacaagaattaagttgtgagatggagagaagtagtgaagaggagatgttaataacgaaaggtccatggacagagcaagaggattctcttctcttcaattacatcactgtccacggcgaaggtcactggaactctgtcgctcgctacacaggcatgcaaagcattaattatattcatcatcttaatcctagcttctttcttactcacactcatcacgttttcaatcacaggtctaaaacgaacgggcaaaagctgcagattaagatggttgaactacttgcgtccaaatgttcgacgtgggaacataaccctccaagaacagctcttgattcttgacctccattcccgttggggcaacaggtggtcgaaaatagctgaacatttaccgggaagaacagacaacgagataaagaattattggagaacgagagtggtaaagcaggctaagcaactaaaatgtgatgtgaacagcaagcaattcagggacacgttgcgttttgtgtggatgccacgtatgctagagcggattcgggctcaggcctcatcatcggcccaagcccaccaaagcagcttaatctccaacagtaacactcaagcacacagtggattgttgtcatcagcgcttcatgcccacgcgccttctctctctgactcgagcgcgtcgtacaatcttatgggtgctgatgctggaagttgctcatctcatagctactactcagacatagcaggcaatggttttggtggtgcggacttgtggacggatcaaaacatttgctttctgcaacaccagcttgctcatcatgacttgttctgatcatgcatacttcaacatcttgctccaaaattcactctaaactgcaacatataaagcaattgtaacactagtcgtgaaacatgcatgtttctttttatgttaatttggtgtgaaatttaataatctatacttcaattaatttcaagagaactgccatttgttgttagttaagcgtgatttgtacgagatagtgatgagtatttttcgcttaactaagacaattaattttgttcgaaacaaatagaactgataataagaaagtaacaaaactgtttaaacacaataaagttggaacgggaggg

SEQ ID NO: 382 - DNA, 1073 bp, Glycine max
attcggctcgagggaattgaacactggggtcaggatcatcaacctagctagctagtgtatacaacaacaatatgaggaagcccgaggtttctggaaaaaacaacaacattaataacaagcttagaaaggggttgtggtcacctgaagaagatgacaagctcatgaactacatgctaaacagtggacaaggttgttggagcgatgtagccagaaatgcgggccttcaaaggtgtggcaaaagttgtcgccttcgatggatcaattacttgaggcctgatcttaaacgaggtgcattctcaccacaagaagaggaaatcatcatccatttgcattcccttctcggaaacagatggtctcaaatagcggcgcgcttaccagggagaacagacaatgaaattaagaatttttggaattcaacaataaagaaaagactcaagaacatgtcatccaacacctcaccaaatggaagcgagtcctcatatgagcctaataacagagaccttaacatggcagggtttactacttctaatacccaagatcaacaacatgctgattttatgcctatgttcaattcatcatctcaatcaccctccatgcatgccatggttctcaattccataattgacaggttgcctatgctagagcatggactaaacatgccatgttctggtggattcttcaatagcacagggccatgcttctcatcatcacaaagtggagttgacaacaaagggatttatttggaaaatggaggagtatttgggagtgtaaatattggtgcagaaggggatgtgtatgttccccctctagagagtgttagcactacttctgaccataacctgaaagtggagagcacatgcaacacagatactaacaatagttactttgatgacataaacagtatcctccttaataattgcaacattaatagcaacaataagagagctgaaaatagggctggtggggtggagaatttgtttcaggaagagttaaccattggagagtgggacttggaggagttaatgaaagatgtttcatcctttccctttcttgatttttcaaatatccaataa

SEQ ID NO: 383 - DNA, 1226 bp, Glycine max
gaagtgaaaccatcaatcccctgtatatataaccactcttcctctcctccaaattaaaacacttatcatggatgttaagaaaggtgggtctgtagtacaagcacaagtgaagttgcagaagcataacgaaaaggagatgggcatgagaaaaggtccatgggcggttgaggaggacaccattctggtcaattacatcgccacacacggtgaaggccactggaattccgtggcacgatgtgcaggcatgcatgcatcttaattataatttaatttctgcatgtgccaagtaataatggtatatatgttaattatgagatttatcaattacaggtctaaggaggagtgggaagagttgcagattaaggtggctaaactacttgcgcccagacgtgcggcgtggaaatatcacactccaagaacaaatattaattctcgaccttcactctcgctggggcaacaggtatggtataaaaatattccactctctctctctctctatatatatattaatttgttttataaggttggatgtacacatatataacatagtatgaatgaatgaatgttttttgataggtggtcaaagattgctcaacagctgccaggaagaacagacaacgaaataaagaactattggaggaccagagtgataaaacaagcgaagcagctaaagtgcgatgtgaatagcaaacagttcagagacacgttgcgttacgtttggatgccgcgcttgctggagcggcttcagcccacatcacaagcactggagccaaaccaaagtggacttgtgttacacgcttcatcatcactgcttccttcgaattccgaccatagtattgaaagggggtcggatctgtggccaggtttcaataaccaaatgttgttggaacaggggagtggcggtgacttgttggaaagtttgtgggatgacgacaatatgtgctttttgcaacagctttcttatgacctccaaatgaaataaaatacaattcccttccgtcacgcattctgcaatgcacagtgctgaaagttgagcatgcgttcaatgaatattgttttcctcactttcatgtacatattaaatcttagagactaaactagtcacgtgcctaaaagttgataccagttgaaataatatggtttattaatccttaattgaaaaaaatagtctatgcctttgtttatgtagttatcataagaattactccctccactacatattgatt

SEQ ID NO: 384 - DNA, 1634 bp, Glycine max
cggctgcgagaagacgacagaagggggtggcaatgactatggaaggtgaatggaaggtgtcgtatggaatttagagcatgattttagagaagtattaaagtgtatagtattcactttgacttgatctcactccccaaaatgggatacagacatagtaatagtatattatacactatgcatcttgcgtaggccaatttgctttgtaactttagtttctcccttgaccccatttaagtcctgcatatgtatgcgtagtttttttatagttttagtgagtgagaatagccatgtctacttcaaagagcgtcagcagttctagtgaagatgacaatgaacttagaagagggccttggactctggaagaggataacttgctctcccaatatatttttaatcatggggaagggcgatggaatttgctggctaaacgttcaggattaaagagaactgggaaaagttgcagattaaggtggctaaattatctaaagccagatgtaaaacggggaaatttaaccccacaagagcaacttataattcttgaactccactcaaagtggggaaacaggtggtcaaaaattgcacaacatttgccaggcagaacagacaatgaaatcaagaactattggagaactaggattcagaaacaagcaagacatttgaaaatttacactgacagcagagagtttcaagaacttgttaggcgtttctggatgcctagattgcttcagaaagcaaaagaatcatcttcttcaaacatgtcaattcaaaaccaggcaattcctatgccttttgattatgtttctcagcatttaactgttgggaccatacctccttggcagggaccttgtatgaatgaagctggtcccacttacatggaccaacatgagcagaactcagactcggaacacaacaatggttcatgcatctccttgtctgagtcagcaaatattccaaaagtgcctcagcattttggacacaccaccatcacccaatttcatgccttgaataccaatgactttggcaccttcacatatgaaggttataatgtaaacaacaatgtctatgagatggacaacttcaaaacgactactacatgggtggctgaggatgcgcaatacccaattggtgattgtcaaatggtaggaagcaattgggtaaacaacgattttgcatgtaacatgtggaacatggatgaactgtggcagtttagcaagttacaaaaataagattttagggttttgttttttttggaataaccaaaagtccaaaactctttctttgatgacgttattattgttatcatgaactgtggattagctaccgaattaattaatacagatggcgattgttttctgtacatctgtcttgtattactctgttcagataagtacttttgtaatttgtattgattgagaaaagtcattaattagtcactagtacaaaacacaaacagttggaaattgagtgctaataaagaattcgtaaatatatagaagtaaacacttttagaaactttggtgcatttgtaggggaaatcggaatgccgaatgcagccactatgatatctaaatgaagagggcccgtgattgaatgaggatgcaattgaagccaataaagatagttcgtttttcagt

SEQ ID NO: 385 - DNA, 852 bp, Gossypium hirsutum
tgcagatcttggtggtagtagcaaatattcaaatgttaactgcaggtttcagaagagagagtaaattgcaaagtaaatatgaataaggatttcatagctgaagaacttgacaatgacatgcaagaagaagaagaagaaggtgttgggggtgatcatggtttcccagatgatgaaaagaagaagaaaggttatggaaggagaggagccgctggtggcggtggtggggtgtcgccgcctgcttgtcaagtggaaaaatgtgggcttgatttatctgatgccaagcgataccacaggcgccataaggtgtgtgagattcatgccaaggcgccatttgtggttgttgctggtctcaggcaacgcttctgtcaacaatgcagcagattccatgagctaccggagttcgatgaagcaaaacggagctgtcgaaggcggttggccgggcataacgaaaggcgtcggaagagctcagctgaatcatcatcagcagcagaaagttcaagtcgcagagggatgatgatcagtgctcaactgaaagagtctcattacctagctgatgatcaaagagccagagtcaatccaatggcaatccatggcagttcatcttttaagcgttcccaaatcagataaggaagcttaagcgaccaaaacaatacgctccctctcttctgtcatccgatggttcatgtcttgcactatgtactacttactagattttaatggaggattttaataacaatgtcaggcatcaactcgattatcgagatttcacaaagtttgttttcatgcgaacttgccttgctgtataatgatgataatatccctttatctatggagtcttcaattgtatttgca

SEQ ID NO: 386 - DNA, 756 bp, Gossypium hirsutum
  misc_feature (671)..(671): n is a, c, g, or t
  misc_feature (701)..(702): n is a, c, g, or t
ggattgcaagagaaatggaaatcaatttcataaagtgctcttatcctgcctgccccttgtgttcaattctttttttgttgcatttcataatgataagtgattagtttatggtgaatgaaggtttcattgtttggcggagtttgatgaaggaaaacgaagttgcaggaagcgtctcgatggacataaccgaagacggagaaaacctcaacctcaacctcaacctcattctctatctgtaaatccaggaagatgtctttccaatctcgcaggttctagacatttaccgtccagtagtccccaaatatttgccactactgccataacctcttcttggttgggaactgccaaaatggaacctgatataggctcggaatccagccgaaatggtttcttccgtggatcctttccacacagctacaaaagggaagaacagttgtcattattacaaaccaatcattcatcactccatggagtttctgtttatcagttacctttattaagcaatggtgtaggcagcagccaaaaaatgttctcaaatgcgatcgactccgatcgtgctctctctcttctgtcatcacagccggctgagaactcggagattggtttgaaaaccatggtgctatctggtccaacttcatcactgatcccaaacatgcaatataatggtgtancaatggaaggtgagcatgtttttggcactnngacgcatgataacacaacatctatggacaaaaaatgtttggatctgcaaatgtc

SEQ ID NO: 387 - DNA, 960 bp, Gossypium hirsutum
ggcagagaaaaaaaggagagacaaagattatggaacatgatgatatgttcatggggaaccgaagccaaactggtaataagtataaccccaacaatgcaaccaccaacagtttcaacttcgagaccacgctcactgagtctcacgcgctgaaccacccgcaccaacaacaacaacgatactctctttacgccggcgatgggtcgagtcgtattcaccaatcggcagatcctcatcttgtttgtttgaagcttgggaagagacattactttgagggttcaacagatctgaacaacaatcgtcactccgccggtgggttctctattggaaagaaaggtaaaccctattatgataatcttagcggcgaaggaggtggaccttcttcgtcgacgggaccgaggtgtcaagttgaagggtgtaatgttacactagtcaacgctaaagactatcaccggagacataaagtttgtgaaacacactctaaagcacccaaggtggtggtgttagggttagagcaacgcttttgtcaacagtgtagcaggtttcatttagtgtcagaatttgacgactctaagaggagttgcagaaggagattagcaggtcataatgagcgtagaagaaaaacctctcaagattctgctaccaggaactttgctcatgataataaaccgatgactgggagttttccgtatgtatcgtcgccaacaggacgtgctctctctcttctgtcatccaaggttgattcttggatctccccgtctaatctctccacaagatctagtgccgccttgcgtgagctgattgtggaaaaccgtgctgctgtcctcgcacggcagctcgtactcgagcgtgactggcactatataggtgagccccagcctgcagggtccaatcctatattagttcagcatcactcaatgcttgaccctcatcgttgggactttccgttcccggaaatcggtg

SEQ ID NO: 388 - DNA, 1591 bp, Gossypium hirsutum
aagtgtcaggtgcctaacttttagcttcaagttctattcagattattgaaaattaaatccatttactaacattttggtttattttgattgggtgttgtatattgagataagaaaaaagagtttttgtttatcattattattcatgacccacgaaaaataaagaaaaaagaccccatgaacgggctgtaggcaggcagagctcatggaaatgggttcgggctctttgacagactcaggtggttcttcctccaactcctccactgagtcactcaacggcttgaaatttggtcaaaaaatctattttgaggatacatcagctgctggcaccggtggtggtacgaccatggggactccactcaagtcaggtatcgggtcttcaagctcatccgggtcgggtaagaaggccaggggtggagtggtgcaaggtggtcagcctccaagatgtcaagtagaagggtgtaaagtggatctgactgatgcaaaagcttactattcaaggcataaggtttgtggtatgcactctaaggcagctaaagtcattgttgctggtcttgagcaaagattttgccagcaatgtagcagatttcatcagcttcctgaatttgaccaaaggaaacggagttgccgtagacggttagcaggtcacaatgagcgacggaggaaaccaccaccgggatcattattatcctctcgttatatccggctttcttcgtctattatcgaaagcagcagaggtggaagctttatcatggatttcacagcctatccaaggctttccagaagggatgtgtggctaacatcaagatcatcggaacatgtaccgggaaatcaatacactggaacaggatggttgcttccacatccatgtcaaaacaactcagagaatcctccacctaacctttacaggcaggaattaccagggggaactggtgttcctagtggccggattcctccgggagaatgcttcacgggagttgttgactcaaactgtgctctctctcttctatcaaatcaaccatggggcttcagaaatcagggattgactcttgggttaaatgacatgatcaactccgagctttgttcaatgtctcaaccagcaatgcctcatggtgcagttacgaatccttactcaaatgcctcttggggtttcaagggcaaccactcctgtagtcgctcccaggatatgctgcctcaaatcccagagcctattaacagtcaattgaccgggggacttcagttgtctcaccaaagcagggggcaatacatggagcatgagccatctaatgcggatgacacctccatgcagcatattcaccaatccttctaagtctgctgtgataatcattcctgcaaatattggtcagtttttgtgcccagtcttacttagtgcgtgatttttggtgtttctggcattatcgtttcttttttgggttggagtttgttaaaaacccaaactaccccttcatgttgtgtgtgcctatggttaaaacatgattaataggtgagaaagttttagcctaaaaaaaaaagtaagcataaataaaattcagagactatttctctagaaattattttttttttttttttgggc

SEQ ID NO: 389 - DNA, 1237 bp, Gossypium hirsutum
aaaagagtaaatttgactaaaataggatcaggaaaaattacattatcttcaacgtgtgaaccttaccaagttaaaaattaaagtttaagatttgtggcaatcaattcatctgattggaataaaagctattatcatatggaaccttgagaatctgaaactcttgaagatggttgtcaccctcaacttgggattgagtagtctgctcttgttccatctgccagttttcagataaggcatatggaatggggaaactctgcgaaatcacattcatcgtgggctgagacatgctgctaccactaacatgcacagggtacgcaagtgaaccatgttgttttggctcacaagaaaccgaagactcatttgacagaagagagagagcacgatgaagatcttgcgtcgtacccatatttgaagcaactgtggattcttctacaccttggttgagaacctcaactgtgttttgcttgccctttacaggcaggaatctgttggaatcgtaacaccgagatgtcatggaattcaacagctggttgcctggcagttgcagctgtccatttgcatttcccgcttttgtaggtgcataacctttcgtttcagaggacttggagacaaatgtgccttcccatgtaaaattttcattgggcctagcattatgaagaaatggcactttattccagacaaaactcatcagttgtttcccatcatatgctgctggtgaaggccttgcagcactgaagtggattgcatctgtctgtggtttgcggcgccttgcattgtggtcagaaagacgccggcggcagcttcgcttcttttcatcaaactctgacagagcatggaacctgctacactgctggcagaaccggagctccagaccacctacaataaccttagggctctttgagtgactttcacaaactctgtgtttccgatggtaatccttagccgaagaaaggtcaaggttacagccttcgacttggcaacgcagaatatgttttgtctgacaattgggtttggatctctttgccggggaaggggatggtccaggagtggctgaataaggtgaagtctttgaattgcttcctgtgcaaacatcttcaaagtatgtttgcttgccaagctttaaagtgagcaatggctcaccagagccaactgaagcctcaaatattggggaactaccggtgtgctcaaccttggaaacctttttcttgttgctaatttcatgtggtatagcttcaaa

SEQ ID NO: 390 - DNA, 1780 bp, Gossypium hirsutum
agcattagtgatgacttgcaaagaacattgagcagcataggggctatagttggtatgtactttttggtaaaattgatgttcgaggccgagtcagattcaggtttgatctattttggttaaattaattcagttcacttcaagtttaatcagttaactgaatttttgcagagccgccgcggcgccattttggttaaattaattcagttaactgaatttttgcatatacccatagatcgatacatggtgttaagagacattgtccgattcatgagtaaaagccaacatcatatggagccttaagcaataggaactcccgaaaacggtcgtcgacgtcgctagtatgcatgcgggacttggtggttgtttcttcttgttgttcgatctgccagttttctggcaaggcatgttgaaaaccttgtgggattgcattcattgctggctgagatgtactggtaaggttgacatgcataatggggtaggtaagtgaaccgtgtttcggttcacttgaaatctgggaatcatttgacagaagagagagagcacgttgaagttcttgagctctgccggtgtttgaagcaaccatagattgttctacacctgcaaaatttgacaaaaaacctgtaagctcgtaacatcagttccatcactggtttatcagtcgccgcggccgctattggcccgaaaatacttatccaagaatgaaatctagtacataacggggtagcacattgagacttcacctcaacggtctcaacagcatcggtgttcaagaataaaagcacttttcgtgttaaaagtagcagtaaaagatggcaacatttatagacattcaagcaaatgcatatcatataccttgtttcctagtagaaaagtgaaaacatacctccatcaagaacctcagccgtgttttgcttacccttagagggtaggaatttgttgaaatcatgacatcgcatcgtgatggcggccgcctgctgattgattggaagttgcacctgttcattgatgtttccaagtttcataggcatataacttgtcattcgagaggacttggagtagaacgtgccttccatcgcaaatttcttcttgggtctaacattatgaagaattgggacttcattccagacaaaactcgtatgttgcttcccatctgcaaaaagcataacttatcaaagccttacgtattcacatcccgatatctatcatatttacatgaccacaagatgaagatgatgatttagttaacgagcaactcaagcagataatttgagagctaaaaggaaagaaaccgaacagagtgtcatgatgatctatctattcacgtaacaggatcatacaacaaaaaacaataaaagtcaagtttaaaatggtaccatatgatgatgaaatccttgcagcattgaagtgggtagcttcagtttgtggtttgcggcgtcttgcattgtggtcggaaagtcgccgacgacagcttcgtttgtttacatcaaattccgacagcgcatggaacctttagcatcagcaacaacaatacaacatgattatgatttcaacattcattacgaaatagacccaaaccaaataaataaaaatttcacctgctacattgctggcagaaccggcgttccagaccgcttacaatgaccttcggactctttgaatggctttcacaaactttgtgtttccgatgataatctcgagcagaagagaggtcaaggttacaaccttcgacttggcaacgcacaacatgtgtgcttcgacaattcagtttggatctctttgc

SEQ ID NO: 391 - DNA, 935 bp, Gossypium hirsutum
agaaagagcacattttctatcttattttcgtaacccagaaaaacaaaaaccccatgaaggggcactaggcaaaactcatggaaatgggttcgggctctttgactgagtcgggcggttctcccaccaactcttccgccgagtcactcaacggcttgaagttcggtaaaaagatctactttgaggatacagccgctgtcgccgccgccgctggtggtaaaagtgttggtggtggtgcaaacatagggactccatccaagtccggtccagcatcttcaagcttagccgggtcgtgtaggaaagccagggttgatggaatggcgcaaggggttctgccttctaggtgtcaagtagaagggtgtaaagtggatctgagtgatgctaaggcttactattcaaggcataaggtttgttgtatgcactctaagtcatctaaagtcattgttgctggtctcgagcaaagattttgtcagcagtgtagcagatttcatcagctttctgaatttgacaaagggaaacggagttgtcgtagacggcttgcaggtcacaatgagcgacgcaggaaaccaccacctggatcattattttcctctccttatggccggctttcttcctctattattgaaaatggcagtagaggtggaagctttatagtggatttctcagcatacccaaggctttcaggaagggatgcatggccagcagctcgatcgttagaatgcataactggaaatcgaagcacagccactggaagctcattttcacatccacggcaaaacaactccagcaaacctcctcatgaccatttcttgcaaggttcaccatgtgggactagtttctccagcactggaatttctccaggagaatgcttcacagggtctggtgactcaagctgtgctctctctcttctgtcaaatcaaccgtggggctccaggaac

SEQ ID NO: 392 - DNA, 2395 bp, Gossypium hirsutum
acttaaggttagttatgaatcttaaattaaaaataggggcctaatataaggtctcatatgctagtcttttaggtctatttagcccatataacccatagtcatagtcagacatgaactctaaacatatagagaaacatactaataaaaaccgaactcatcgaatagcctgatacttctttcatatctgaaatagctacctacaatggcgggaaatgcggctaacgtgggcatcgatattaactaagaaagttgattgaatggttgtgcggacaattcagcggccgcgtcgacagacgtcgaagatgcctgatcgaagaaaataccaaagggactgggccaagctgcagggcgaccggtgaaaactgattgatccgatgaaagaacaagatcatatccatatttcattaaaatctgttctctattcactacctttttttgaagaaattacaatttcttatcatttttatgtctcttttgttcaatatattagcctgcttgttcaaaatttctaatgaatgttttttaatccaaaacttctcagagctgaagcattagtgatgttcaattggatgacttgcaaagaacactgagcagcatgggggctatagttggagtaaaagccaacatcatatggagccttaagcagtaggaactcccgaaaacggttgtcgacgtcgctagtatgcatgcgggacttgggggttgtttcttcttgttgtccgatctgccagttttctggcaaggcatgttgaaaaccttgtgggattgcattcattgctggctgagatgtactggtagggtcgacatgcataatggggtaggtaagtgaaccgtgttttggttcacttgaaacctgggaatcatttgacagaagagagagagcacggtgaagttcttgagctctgccggtgcttgaagcaaccatagattgttctacacctccatcaagaacctcagccgtgttttgcttacccttagagggtaggaatttgttgaaatcatgacatcgcatcgtgatgggatttgacagctgattgattggaagttgcacctgttcattgatgtttccaagtttcgtaggcgtataacttgtcatttgagaggacttggagtagaacgtgccttccaatgcaaatttcttgttgggtctagcattatgaagaattgggacttcattccagacaaaactcgtacgttgcttcccatcatatgacgaggatgacaacgatggaatccttgcagcattgaagtgggtagcttcagtttgcggtttgcggcgtctcgcattgtggtcggaaagtcgccgacgacaacttcgtttgttttcatcaaattccgacagcgcatggaacctgctacattgctggcagaaccggcgttccagaccgcttacaatgaccttcggactctttgaatgattttcacaaactttgtgtttccgatggtaatctcgagcagaagaaaggtcaaggttacaaccttcgacttggcaacgtacagcatgtgtgcttcgacaattcagtttggatctctttgcagataaaggagatgatgttcccagagtggcagaataagatgaatccgtagcattggttcccgtactaacatcttcaaagtatgtttgtttgccaagctttaaactgagtaatggctcaccagagccaacagaagccacgagtgtcaaggaagtactggttgtctcaatcccagaaacttctttcttattgcttatatcatctgggatagcttcagaagcctccaaagtaaatttggtcaattttgcctcccccatagataaagaatcaatggatgccgatttcaaatttttagacaaagacacaaggcctaaatccgagccagaaccaccactacaaccagcaacactggaagaattgacagacacagagtccaatcctccttccccttcatcaatatcccactctacgggtcttagccttctcgggatttcagttgcttttgcgtttaacattaggttttcccagtcccattgcaacggggtctgttcgttccactccatcagagagataaaactcatagaacacttcacacaatcatcattttataaactggaaaattcagtccccagatccactaaatctcacagcattggacttcaaccatcattctcggatcttgcaaattctggataagattagctatactggctttcctccttcctttcattatgactaatacgaactagctgaagttcaaaagtgatctatccgttcgagctcatacaatcaaaagccaatcagaagaaaatgggaaatgagtggaaagttaagagcttgaaagggaaaggaaatcaaaaggcagagctgagttctgactcactccttttattagaggctgaagtcagcggacgcgtggg

SEQ ID NO: 393 - DNA, 766 bp, Gossypium hirsutum
cctcttctttttctccctttttttaaccttattatctctcaaagagactattttttttattcttcttcttcatagaaaacctcttcatctcattcatctcctcttttcttttgtgattttttaagcaaaacccagaaatggcaacaagcaaagctgaagggaaaaggagaccgaaggaaatgggggaggaggaagaagaagaagaagaggacgaggataatagtactactggtgacgatgacaagaagaaaaaaggcaaaagagggtccagtacggtggtcggaggctcctgtcttccagcctgtcaggtcgagaactgcactgccgacatgaccgatgccaaacggtaccatcggcgacataaggtgtgtgagttccatgccaaggctgctgtggttcgagttgctgggatccatcaacgcttttgtcaacaatgtagcaggttccatgagttatcagagtttgatgaaacaaaaaggagctgtcgacgacgtttggccggacacaacgagcgccgtcggaaaagttcatcggaatatcatggagaaggctcaaatttttaaaactagctaagaaggcaagcctaagatatatatatatatatgcaaaaaagagtcaattcagtcttgaatttaatatgatcctatgtatgggaacggactttcccagatgatcatgtaactatatggaatttactaattaagcatgctctctctcttctgtcaatcttaattttacccctatttgtctcgtcctctgcctgatg

SEQ ID NO: 394 - DNA, 547 bp, Gossypium hirsutum
agaaatgacgagggaaaaaactgctatagcagatgaacatatagtttcatctaaagtattcatacatatcattgggggcccctttaaacaaaagttcattaaatattctgaaagcaaaacacacaaacaacttcataaattccatctggtttgaaggaagaatggaatgggcagatattcactcccatgagaaggagagtgtatggtgagcaccagttgcagaggaaccaaaatgttcattttggaacatttcatgcccttggaggtggctgttgttacctccaccatcggcgtccaaaatggaggtcccgattggctcacctcccattcctcctacatcattaaattgcaagtttgggatgacgaaggaagcagaggcaggttgcaccatggggctcaaacctatctcccgagtctcagccggttgcgatgacagaagagagagagcacgatcagagtcaatagcttgattcaactcatcggagaacattttccggctgttgtcaccactgcttgacgcctcgagaaacggttgacaaagggaacc

SEQ ID NO: 395 - DNA, 1063 bp, Gossypium hirsutum
atgatatcttgcagaacaatagctatgagatgcctgatgtcatatttgacagtttaaaggccaatcaaaatgtgcttccttatgttcctgagcttcctgttttatccgctagcagcatgctgatgaaaggtctaggttcttctcaatattgtaggttttataccaccagcaattcatcgccagaagcgtcttcgagaatcagctgccttttcccctggttacactgctgctgttaaaaatgactgccccttgttccggcagtttcaagatgatatgtcagacaaggctgctcaatcctttgggttgtcttttccaattgaaccagatcctgcaaccaagaactccttgcaatttggtgtattcccaggtagccataacctttcaaatggcaatttctctgcttcagagcctcctttggaggctgtgaagttggagctcccttcactccaatatccagaaactgaattaggtaactggggcacattttcttgcccaccacctttacttgagtctgttgatgcttttatccagtcaccaccaccaaccagcatagcagagtcggatagcctttcaccccgtaatagtggcctgctggatgctttacttcatgaggcaaaaactctaagcagtgcaaagaaccatgcatctgagaagagttcaaattcagctactcccggtgatatagctgaaagttccaccttcaacatctgtgagacagaatgggaaaactgtggtgagcctctttctccaatgggtcattcagcaacttctcttttaagtgagtgtatcagtgcaagtggcagtacgttggatgaacagccacctgctgaaacctttactgagtctcatgtgaaatcagagccagctgactatgttttcaccccagagatacaaaatgaggctcctattcggttggacagttgtcaccctgatacattacttgcttctaattggcttgagcaagattctggttacgataaggaccaaaccatcatgaccgattccatagctgcccctcttggtgatgattgagtagtgaatacaagatatggcagctggaaca

SEQ ID NO: 396 - DNA, 1865 bp, Gossypium hirsutum
  misc_feature (1757)..(1757): n is a, c, g, or t
  misc_feature (1783)..(1783): n is a, c, g, or t
  misc_feature (1788)..(1788): n is a, c, g, or t
attcttcgtttcaaattacaacaactcaaccaaaaaataaaaaaataaaaatctgatctttgtttcagctgaattttcattaaaagtattgcatttttaattgttttctttgtgtatatgtgtgtgtatatatattgggatttaagaactgaagatcctttcaattcaaaagagaatttgagtctggaatattttcttcttgttgagggattgaattaccttagcatgcgtgtgatatggtgtttaagaagaggttagattatggattcaatgccttcaatgtccacgatgtaccccgagcccctcgatccatgcggaggaggagtcaaagtaagtgtacagttgaggaaagtcagttttgcgcattcgaaatgttagcttctctagctgggaagctactgcaggagagtgaaagttctgcttcgagcaatgcttcagaaggacatgaatgtgattctataggtaaaaattgttttaaacaggaaatccagtacgaagataagcctttgaaacccaaatgttttgagcaaggaaggtgtgaagcaagcgttgctgcctcagagttgactactgaaaatggtgatgattcgaaggacttcagatgtgctaaaaataatgccatcttggaatgcactttgacaaagacggatcctgcttgctcagaggaaatcaatggcgatttaaagtatgggagttttccgggtaatgtagatggtcactccccttattttggggagtcgtataatggtaaaactgagaatgcatttaaacaagagcgagatcctacgggtttggagactcaggctctaaatattgctaataaaggccctccaaaggatcccgttaactttgatagagttgtcaaattgctatcacgtcgggaccctgttcctagtgttccatttacaagacgtaggaatgatattaagttaggcaatagagatgatgaagaaaacttttctaggttaaagagacttagcaagaggtttaaggcttctagacctccaacacatatcggagaccgaagaataaggaagttgctgacatccaaatactggaaagttgctgcaaagttgaaggattttgaacattctagatttggaggaaaaaggcctctgtattgcaagcggaagacatactacaactaccacagatgtcagtatgacatgctttataaacagaggaagatctttgaccgtaaaagcgttactagttatcctgagaaggatatgattggtgataagtgtagcacagctgcaatgtcagatagagtgaaatttagcatcaagtcctttaggattccagaactttacatcgaggtgcctgaaactgcaactgttggttcactgaagaggaccgtaatggaggcagtgacagccttaattggaggtggaatacgtgttgggctactccttaagggaaaaaggtgagagatgacagcagagctctatcacagctggtatttcctgtgatgataatctggatgctctcggtttcactttggagcctggtcctgcaaaagctccttcaccatgtgctctgaagaaccacctcttttattatcatatgacgccaccctgcaaaatttaacgagctctctggccgctcagctgtaaatactggcattccgaatgcacacccaacctaccttttctgaccaattcagaaaatcctgcgactgaccatgaacctgtttccttcaaactgacatgccaccgatcaaagctgttgagtcagggctctggtccggttcagtncagcaacaatgtgagcactaactctntcagnaaacagaattcaaaatttgactgacaggtcatattgagcgttcttatagagtcaacatgttcagcgttaggaatgtc

SEQ ID NO: 397 - DNA, 1201 bp, Gossypium hirsutum
agccttccgccaacgcttccgcaagtcttcaaccggatggaatgctactgctggaaattgtatgatcccgggtggggggttttcagcatttctgagggaagaggagggtaagctgatgagaaatggaagcggtaatggggttagctcaaatggtaatttgatggggaagaggaaggttaggcctgaacaagttattgaagctgcaacacttgcttccaatggccaacaattcgaggtcgtttactacccaagggcgagtactcctgagttctgcgtgaaggcctctttagtgaaggctgcattgcagatccggtggtgctcaggaatgaggttcaaaatggcattcgaaacagaggattcttctcggattagttggtttatgggcactatatcttcagttcaagtcgcagatcccctccactggcctgactcaccttggaggcttcttcaggttacatgggacgagccagatttgcttcagaatgtcaaacgagttagtccttggctggtggaattggtttcgaacatgcccgcgattcatctatctcccttttcaccaccaaggaaaaagttgagactgccgcagcactcgtgattttcacctagatggtcaacttccaatgccgacattttcaggcaacctccttggggccagcaacccctttgggtgtttacccaacactgctcctgctggcatgcagggagccaggcatgctcattacggtctatctttatcagatctccacctcaataaactgcagtcaggtctctttccggctagtttcccaccacttgattacgctcctgtacctaataggacctccaatggtggcccaaacattccaaagcctagcatgagtgagaacgtttcttgtgtgctaaccatgtcccatccctcacagaattccaagaaagctgatggtgcaaagacacctcagcttgtacttttcggtcggcctattcttactgagcagcagatctctctcagctgctctggtgatacaagctcaccagttcttactggaaatagttcttcagaatatctggataaggcagcaaacttttccgatggttctggatctgctcttcatcaacaatgccttcctgagcgagcatcctgcgaaggtctcccgtggtacaaaaacaatcgccaagaagctgaacccaattttaagactggcccctgaaacgtttcatgcac

SEQ ID NO: 398 - DNA, 1255 bp, Gossypium hirsutum
gcggcacccacactccagctctctctctctctaactttccccgccttccaagcaacatcttcatatgctttccatagctaaatgtacgtatatataaccaacacaccctcactctcttcaatgaccaaaaatcaattttaaaaatcaaagaaaaaaatctcttttttttgttgtaatttcttggattttccgatatgggttttgaagattcagatagggtatcgaaaccagtaatgataagggaagtttggtcagataatttggaatccgagttcgagttgatcagccaagtgatcgacgaatacccatttatttcaatggatactgagttcccgggtataattttccggccaaaagtggaccccgcaaggcagtacaacggtcagttccgaccggccgatcattacaaggtactcaaatctaacgtcgatgctttgaatttgatccaagtgggtctaacccttaccgattcttcgggtaatctgcccggatccgaaaacggaacccggttcatctgggaattcaatctccgtgattttgacgtggagcgagatcctcacgcgccggattccatcgagcttttgaggaggcaagggattgattttgacaagaataaggaaaaggggatcgactcggttcggttcgctgagttgatgatgtcgtctggactcgtgtgtaatgactcagtgagttgggtgacgtttcatagcgcctatgattttgggtatttggttaagatcctgacccgacgagatttgcccgagaaattagacgagtttttgacgattcttaaagtgttcttcggtgaccgagtttatgatttgaaacacatgatgaagttttgtaacagcttgtatggtgggttggaccgagttgctcggactttagatgtgaaccgggcggttgggaaatgtcatcaagccgggtccgattctttgctgacgtggcacgcgtttcagaaaatgagagacttgtattttgttaacgatggaccggaaaagcatgccggagtattatttggattagaggtttattaattattttttttgttaattacaatgtaaaattattcgaagtataattaattctattcaatttattggattaaaaaaaaaaaaaaaaaaaaaaaaggggcggcccgtctttaggggaccaaagttttcttccccgttgtttgcagaggaataagttttttattttggcccctaaaaaaaaaataccgcgccgcgttttaacaacctgtaaggggacaagc

SEQ ID NO: 399 - DNA, 625 bp, Gossypium hirsutum
tgggtcatgcaagaattcagggttcaaccaacctccaacgtctccactttgaaggaagattgggttttatgtcgaatgtttcacaaaaccaaggaaattagtaaaaaccctagtatcatgggaagcagttatgatgacatagcttcttcacctcttccaccattgatggattctttcatcagttttcatcaaccaaatttagattataagtatgagcagcaagtgccctgattctccaatttgttcccaaaccaaaggaacactattttcaccaatatggacccaaatatgccgaaaaaaaacacaaacagctgttggacaaataaccatcaatgtggcatgcttagactctttcccttgtgacaaaaaaaagtgatcaaagctatgctgaatcatcttagcaaaatggatacctatcttaatgtgaaggaaccattgagctttggagaaggaagttcagattagagctatttatctgaagtttggaattaatgcctaaactacatagtcatggttgtataaagttaaaattacaaacttagggcatatttttttcccattaaagcatcatacacttgtttcataatactttaatattgatcaaattctaaatgatttcatgtgg

SEQ ID NO: 400 - DNA, 1480 bp, Gossypium hirsutum
acttcctttttttcttaacaccatcgccaccaccttttcacttcatatcttccatctcttttcctcttcctttatccaccttctccctcactttttgtcctttgagtttggcttttcattgttttatccatcttataaaaactggggttatcctttcttaatttgattcgtataattgttgaagtcgtctaagctgaggagtaagcgaagggttttgaaatggaaaacgtttctagctttaggaacgaagatgaacaaatggaactgcctccaggatttcgattccaccccacagatgaagagctgataacacactttctctccaagaaagttgttgacagcttcttctctgctatcgccattggtgaggttgatttgaacaagtgtgaaccttgggatttgccttggagagccaaaatgggtgaaaaggaatggtacttcttctgtgttagggaccggaaatacccgactggtttgagaacaaacagggcaacggatgccggttattggaaagccacgggaaaagataaagagatattcaaggggaaatcacttgttgggatgaagaaaactttggttttctacaaagggagagcacccaaaggtcaaaaaaccaattgggtcatgcatgaatttcgtttagaaggccagtattccgtttacaatcttcccaaaacagccaagaacgagtgggttatttgtagagtattccaaaagagtcccaatggcaaaaaggtacatatttcaggtttgcctccactaatggacccctcaccgcacaccagcgaagcaagaacggtggtgggcgccggcgagacgtcaaacgtgacctgcttctccgatccgatagaagaccgtaaagcagtggaagaaatgatggacagttttcgacacttcccttgtaccttgttcatcatcctctgtgaattctcttcaaaaggcttcctacaccaccaaccaaatcaagtcgaacatgggaaacttgcagtacccggattgtttttggattcaagaaccgtccttattaaagacattaatccaaagccaaggagggcggtcgaagcagaatctgaaaccagagttttcccaggattcaaccgtgtccaaccctgaaatgattcaacttccttcatgttctgcaggagcaataaacctgggttacttctggggttactaaaattgaatattcaaaactgaaaaaaggaaaaatcaagggatgtaaatggattgaaagagttggaagaatattattgtcatgtgtgcatagataacattagtaggggaagtcaagaaaatgattgtgttgtaaaagtagttaaaactctgttaaggttttcattgccatattaggatttcactcgattatctcatcccatgcctttgtttgatacacaactattgtaattcctaccatattttaattcccatttaattctccaatatgttcgaaaatgtgaagcaaaaaaaaaaaaaaaaaaaa

SEQ ID NO: 401 - DNA, 972 bp, Gossypium hirsutum
ttcacacacaagggaaaggcaatttgagagatttcagaacacttctgagcctctgataaaaacaaacacacatctcatcaccttcagatcatgccctttcttactatataattgtttgcccttttggccccaatataacaccctctcttcattcctttcctcttcagtttcaaacccttgttttcttcacttcttgctgatcaactttgtcctttgaagtccagggttttcggctatggatagttaccatcattttgacaatggtgaaacgcatttacctccaggttttcgtttccatccaactgatgaagagctcattacatactatctggtgaagaaagttcttgataggagctttactggtagagccatagctgaagttgacctcaacaagtgtgagccttgggaacttcctgacagggcaaagatgggagagaaagagtggtacttttttagcctaagagataggaagtacccaactgggttgagaactaaccgagctactgaagctggttactggaaagctactgggaaagatagggagatttatagttcaaagacttgtgcacttgttggaatgaagaaaactctggttttctatagaggaagagctcctaaaggagagaaaagcaactgggtcatgcatgaatatcgccttgaaggcaaatttgcttaccattatctctctagaagctccaaggatgagtgggtaatatccagggtctttcagaagagcagcggaggagccaagaaggcccccatgagcgccgcttccatggtgctctaccaagaaccaagctcaccttcctcggtctgtcttccaccgctcctggataccaccaatgctactgggcagtggtaccgctaccggtgcttccctcactgaccgtgacagctgctcttacgacagccataaccaatccgagcacgtgtcctgtttctccaccattgctgccacctcgtcagccaccc

SEQ ID NO: 402 - DNA, 1539 bp, Gossypium hirsutum
tcaccctaaaatcatattctcaaaacacccccatctcacccctccgttgctattttcaatcaagaaactctccggcagcagtcttgatttggtttccagttagactctgagatagaagagatggcagtgaactagacgacggcgttgaagatgtagagaaaaacaacgaaaagaagcatcacgcctccaagctgtgaataggaagttgacagctatgaataaactgttgatggaggagaatgataggttacaaaagcaagtttcacagcttgtttatgaaaacaactatttccgccaacagactcaaaatacgactttagctaccacggatacaagttgtgaatcagtagtgacgagcggtaaacaccatttgactcctcaacatccgccaagggatgccagccctacaggacttttgtacattgcagaggaaactttaacagagtttctttcaaaggccactggaactgctgtcgagtgggtccaaatgcctgggatgaagcctggttcggattctattggaatcgttgctatttctcatggttgcagtggtgtggcagcacgtgcatgcagacttgtgggactggatcctacaagagtcactgaaatccttaaagatcggccttcatggtatcgtgattgccgagctgtggatgttacaaacgtgttgtccactggaaatggtggaaccattgaactgctttatatgcagtttcttctagtcaagtttgcaaaaatgattagtgtaactgtatccaagttttggaggccggatgtcactcatgtgactgcctctacagatgagaatggtgcatgcactaggacacttaaagttctcatggcaattttaaacgggaagtgggttcttaaattaaattacgtcaggagattttcaaggaaacaacagaccacatgtataataatgcagcgactcaggagcgggaaactactttgaatcagctactaatagagcttgatgggtttgatactggcaaaggtgttatattttcggctgctacaaatcgtagagatttgttagatcctgcacttctcaggcaaggtcgttttgatagcgagactcagccctcgatctcgatgaacagatcttgcagctgatgcaatgtaagccactttcggagcagcaggcaaaatggttgaacaagcaattgagcaaattatggccttttgttgcagaggtgtatactttggctttctatttcggtgttttggattttctggcggttgaattgaaagcatcaaaggacttctctaagttatatgcaggcatggcaatactttggcttcacataagcttgaaccagccttctgttgtatattgtttctttttttttttgatttttttcctttgattaatgagaggtgatgatgaattggcattcttttctcatgaggatgatttttgttttagaaattgttatactttgtgtttgtgtgtgttattttttatgtattaaattacatattgaatcaatgtttatgtattaaatttaaattcattaaaaaaaaaaaaaaaaaaaa

SEQ ID NO: 403 - DNA, 786 bp, Gossypium hirsutum
cccactcgtccgccatgaataaactgttaatggaggagaacgataggttacaaaaacaagtttcccaacttgtttgtgaaaaaagctactttcgccaacagtctcaacagcaggcggggttagccaccacagatacaagctgtgactcagtggtgacaagtggtcatcaacaccatttgactcctcagcatcctccaagggatgccagtcctgcaggacttttgtctattgcagatgaaactttaacagagtttttatcaaaggccactggaaccgctgtggagtgggtccaaatgcctgggatgaagcctggtccggattctattggaatcgttgctatttctcatggttgcactggagtggcagcacgtgcatgcgggcttgtgggacttgatcctaccagggtcgctgaaatccttaaagatcggccgtcatggttccgtgattgccgagctgtggatgttataaacgtgttgtccactggaaacggtgggaccattgaactgctttacatgcagctctatgcgccaacaactttggcaccagctcgtgacttctggttgctgcgctacacatctgttttagaagatggtagtcttgtggtatgtgaaagatcacttaacaatactcagaacggtccgaatgtgccgccagcagcgaatttcgttagagcagaaatgctgcctagtggttacctaattaggccttgtgaaggcggtggatccatcattcacgttgttgatcacatggatttggagccctggttgtctcgtcctctgcctgatg

SEQ ID NO: 404 - DNA, 845 bp, Gossypium hirsutum
aattttcaccctaaaatcatattctcaaaacacccccatctcacccctccgttgctattttcaatcaagaaactctccggcagcagtcttgatttggtttccagttagactctgagatagaagagatggcagtgaactaggcgacggcgttgaagatgtagagaaaaacaacgaaaagaagcatcacgcctccaagctgtgaataggaagttgacagctatgaataaactgttgatggaggagaatgataggttacaaaagcaagtttcacagcttgtttatgaaaacaactatttccgccaacagactcaaaatacggctttagctaccacggatacaagttgtgaatcagtagtgacgagcggtaaacaccatttgactcctcaacatccgccaagggatgccagccctacaggacttttgtacattgcagaggaaactttaacagagtttctttcaaaggccactggaactgctgtcgagtgggtccaaatgcctgggatgaagcctggttcggattctattggaatcgttgctatttctcatggttgcagtggtgtggcagcacgtgcatgcagacttgtgggactggatcctacaagagtcactgaaatccttaaagatcggccttcatggtatcgtgattgccgagctgtggatgttacaaacgtgttgtccactggaaatggtggaaccattgaactgctttatatgcaggtaagttaattaatatcaaatttatcctacttttccaactaagtctatgtgaatatttggacaaaaccagagatcttagtatgtgtatttaaattgttcaccataccacttgtctcgtcctctgcctg

SEQ ID NO: 405 - DNA, 1263 bp, Gossypium hirsutum
cccacgcgtccgcccacgcgtccgcttaaaagatggcaatgtcctgcaaggatggtaaacctgggagcctggatggtgggaaatatgtaaggtacacgcctgagcaggttgaggcccttgaaaggctttatcatgaatgccccaagcctagttctattcgtcgtcagcaactgattagggagtgccctattctctccaacattgaacctaaacagatcaaagtttggttccaaaatagaagatgtagagagaaacagagaaaagaggcatcacgccttcaagctgtaaataggaagctgacagcaatgaacaagcttttgatggaggagaatgataggttgcaaaagcaggtgtcacagctggtttatgaaaacggatgctttcgccaacatactcagaatgctacacttgcaaccaaagatcctagctgtgaatcggcagtgatgagtggtcaacaacgtgaaacacatcagcatcctccaagagatgctagtcctgcagggcttttgtccattgcagaagagactttagcagagtttctttcgaaggccactggaactgctgtagagtgggtccaaatgcctggaatgaaacctggtccggattccataggaatcattgctatttctcatggttgccctggagtggcagcacgtgcctgcggccttgtgggtcttgaacctacaagagttgcggaactcctcaaggataggccttcgtggttccacgattgccgagctgtggatgttctaaatgtgctgcctactgccaatggtggaaccattgagctgctgtacatgcagctctatgcgccgacgacgttggcgcctgctcgtgacttctggttattgcgttatacttctgttctagaagatggaagcctcgttgtctgtgagagatctctgaagaatactcaaaatggccctagcatgcctccagtgcagcattttgtgagagcagaaatgttgccaagtggataccttattcgaccttgtgaagggggtggttcaatcatccatattgttgatcatatggatttggagccatggagtgtgcctgaagtgttgcgcccactttatgaatcatcaacagtgcttgctcagaagacaacgatggcagctttacgacaactgaggcagatagctcaggaggcttctcagtctaatgtgactggttggggacgacggccagcagcttgacgggctcttagccagaggttgagcaggggtttcaatgatgcattgtctcgtcctctgcctgatg

SEQ ID NO: 406 - DNA, 969 bp, Gossypium hirsutum
gcacgaggatgtactctctaacttattacctccatttccaggaagagagtattctgcttaccagagttcaactgatccacaaaacaattttctgtttggggttagcattgattcatcatctcttatgctgcagcaagggatgaccaacctgaaaaatattggaaatgaaaatgattcattgtctatgccatatgccgcttcaaatttcaccagtgcttctggcacagatttccctcttaattcagatatgactacctcaagttgtgtggatgaatcaggttacttgcagtcttctgaatatgtggaccaagtaaaccctccgaccggaacctttgttaaggttcacaagttggggtcctttgggcgctcattggatatttccaagtttagcagctataatgagctgcgttgtgagcttgctcgaatgtttggtctggaaggccaactagaggaccctcagagatcaggctggcagcttgtatttgttgacagggagaatgatattcttctccttggtgatgacccttggcaggaattcgtgaacaacgtgtggtatatcaagatactatctccacttgaagtgcaacaaatggggaaagaaggcctgaatcctgccgcctccgacccaagccaaacgcaccaccaatagtggtgcaggaggagttgagctgagaagttctggtaatggaatttgcatcaatgggtgtcttaaatgctgaaggaaaatgctcctcaaggctgaatttggggaaatgatagaggaagttgtagctttttttcttttaaatgttaaagcttgtgtgttcagaatctagtactgttactgtaaattataataggaaatttctgtagctttacattattatagtacttaaaagagaacaaggttgaattcgggataattgcatcatgttatcagcaatattgtttgccattagtaattttatagcatctacagatgtttaactc

SEQ ID NO: 407 - DNA, 1202 bp, Gossypium hirsutum
ggccaactctgtacttccccaggttgaacagttgggaactgcacaatcaaatgggtgtgaacctaacaacttattacctccatttcctggaagggagtattctgcttaccacaatgcaactgatccacagaacaatcttctctttggggttagcattgattcctcgtctcttatgctgcatcatgggatgacaaacccgaaaagcatcagaaatgagaatgattcgatgtcccttccgtacgctgcttcaaatttcacaagtgcttctggcacagattttcctcttaattcagacatgactacctcaagttgtgtcgatgaatcaggttacttgcagtcctctgaaaatgtggaccaagtaaaccctccaactggaacctttgtcaaggttcacaagtcggggtcctttgggcgctcattggatatttccaagtttggcagctatgatgagctgcgctgtgagcttgctcgactatttggccttgaaggccaattagaggaccctcagagatcaggctggcagcttgtatttgttgacagggagaacgatattcttctccttggtgatgacccatggcaggaattcgtgaacaatgtgtggtatatcaagatactatccccacttgaagtacaacaaatggggaaaggtcagaatcctgctacttctattccgaaccaaaggcttaacaccaccaccaccgctaccaccagcagcagcaatggcaaccactgcgatgactacatgagcagacaggacttgagaagttctgttgcatcaatggggtctcttgaatactaaatgaaaatcctcaggactgaataaagtttttgatgaattgaaaatggaaagttgaaggagataaatcattaacgttgtaggtgttatatggtactgttagtaatatgtaagcatatgtattgatacaacatcaattgaagatttacccttgctgcctgggacctaggttgatattgaagcttttatgtcaagactactactgtactgctgggaaaattataagtggaaatatgattctccgactcaaaataaaaaaaaaaaaaaaaattaatattatttactattttaatatttatattttatatatatatttttttaaagttaacttattctaattttattaagtttatttttaataattatattttaatagggggcgttttttttagagattaaaattttt

SEQ ID NO: 408 - DNA, 972 bp, Gossypium hirsutum
attataacatatttgctttaagttggactgataataatttgcctttgatataacaatatttaatctttccttgtaatctacgctgtaaacttaagaaacaacttggtcaaggcaaggacggtgataaataagtctttggagattgtggaaataagtttgattctgataatacttactattactctcaagttgagtgccatggcagaggccgttgggagtttagtattcaagggaaccaacagatgagagtctaccagtgccggtgtcagtgccggtgctattcattctttgacctggggttgtggggctaaaaggctctgcccgttgctcgcccatcttctgcacatcctctggtgaaagtatctttatgtaccaaacattattcacaaatgcctcccatgggtcgtctccaaggagaagaatatcattctccctgtcgacaaatacaagctgccagcctgatcttaaagggtcttccaacttcccctcaattccaaacatctgagccagctcctctcgcagttcatggtaactgctgaacctggagatgtctaacgagcgtcccactgaccctgatttataaaccttgacaaatgttggagttggggttggtgggtcaacttgccctctgctctgcagctctgaagagtcttgcatgcaaccatacagaggattctggaatgaggagtcccctaatggaattgagggcacatcagcttcacatgaagatgttgcaatagcaggcatcattgtaggaagcagaaggccaaatgaatcgtcgttaacaccaaaaaaagtagaattctgggcatcagaggtaccaatatctggctctattacagcatcttttccaggaaacacttgtggaagtgatgtagagctaccaaaggcatttacctctgaatgggtatacttcggagcccaggaccgcggtgttaactgcccagctagcatgaactgaccggattctgg

SEQ ID NO: 409 - DNA, 921 bp, Gossypium hirsutum
cccacgcgtccgccttaggggagttggcactgatagtgattccacttctatacccttcttttctaattatatgagtactgcagggaatgatttttcggttaatccagcaatgacaccttccagttgcattgatgaattgggattcttgcagtctccagagaatgcgggccaagaaaacccacaaactagaacctttgttaaggtttataaatcagggtccttcgggagatcattggatatttctgcattcagcaactacaatgaacttcgcagtgaactggcacatatgtttggccttgaaggccagttggaggaccctctgagatcaggctggcagcttgtatttgttgaccgggagaatgatgttcttctccttggcgatgacccctggccggagttcgtgaacagtgtctggtgtatcaagatactttccccacaggaagtgcagcaaatgggcaaacgaggcctggagcttctaaactctgtgccagttcagaggctctcgaatggcagttgtgatgactatgtgagccagcaggactcgagaaatcttagctctggtattgcgtctgtggggtcattggactactgaataatcttacctgttaagatgctatttttctccctgtaatgttagtgtgcctcttgcaaccctttttatagtaggtggaaaagagctgcctaactctagctggaactttataatatagcgcatatatatacataagttaaatactgtaactatatgagatcttcgtctcctttggtatggaaatatgtacaattcatatttattaggatatatcaatatttatgaagcaaacttagctttttccgaacaataaaatatgcataagccagaaataaattttggtttttgctaaaatttatgttttctacgatataattaatattttatta

SEQ ID NO: 410 - DNA, 3368 bp, Gossypium hirsutum
aactgatgttccttctgctggaggtgagagctcccactcccacgacacgggtgttggcagtggtcgtgctacccaacgcccttctcagcaaggaggagctggagggggaggatactcaactggaagaggtctggttccacagtcccagcaaactggtcggggaggttacagtgctggtggtcggggtcggggtacgtcacaacagcagtttgctgaaagaccccctgaataccaaggtagaggaaggggtgggcctccccagcaaggaggtcgtgggagctatggcagtggtcgaggcagtggtggcagtggaggagggcctttccatggtggaccatcccgaccaccttatcccgagctgcaccaagcaacccaaccttttcatgggcctgcatcatttgaggcaggttcttcatccagaccccctgagcatgcaccatcggcacagtcgcttcacatcccggaagaagctggccaagcaattcagccagtcccttcatcaagcaagtctgtgaggtttcctcttcggcctggaaagggttgcactggcacaaagtgtatagtcaaggctaaccatttctttgctgaactgccagataaagatttgcaccagtatgatgttactataacaccggaggttgcatcacgtggagtgaaccgagctgtaatggagcagctggtaaaattatacagagaatcatatcttggaaagcaccttcctgcttatgatggtcgaaagagcctttacaccgctgggcctctcccttttgtgtcaaaggagtttaggatcacccttattgatgatgatgatgggtcgggaatgcaaagaagagagtgcgaatttagagttgtgatcaaactggctgcacgtgctgatctgcatcatcttggactctttctgcaagggaagcaagctgatgcacctcaggaagctctccaggttcttgacattgttcttcgtgaattacctacttccaggtactgtcctgttggccgttcattctactcacctgacctagggagaaggcaaccgttgggtgagggattagaaagctggcgtggcttttatcaaagcattcgtcctacacagatggggctatcgcttaatattgatatgtcttctactgctttcattgagcctttgcctgttattgattttgtaacacaattgctaaaccgggatgtttctagaccactatctgatgctgatcgtgtgaagattaaaaaggctcttagaggagtcaaagtagaagttacacaccgtggcaacatgcgaagaaaatatcgaatatctggtttaacatcacaagcaactagagagttgacttttcctgtagatgatagaggtacaatgaaatctgttgtggagtattttcatgaaacttatggtttcatcattcaacatacccaatggccttgtctacaagtcggaaaccagcagagagcaaattatttgccaatggaggtatgcaagattgttgagggtcagaggtactccaagaggttgaatgagaaacagattactgctttactgaaggtcacctgccagcgtcctcaggaaagagagtatgatattatgaagacggtgcaacataatgcttatcatgaagacccttatgctaaggaatttggaattaaaattagtgagaagcttgcttcagttgaagcgcgtattctgcctccaccgtggcttaaatatcatgatactggtagagagaaggattgcctgcctcaggttgggcaatggaatatgatgaacaagaaaatggttaatggtgggactgtaaacaactggatctgcataaacttttctcggcaagtccaagatagtgtggcacggaggttttgttatgagcttgcacaaatgtgttacatctctggcatggcctttactcctgaaccagtgcttcctccaattagtgctcgtcctgagtatgttgagagggttttgaaaacacggtatcatgatgccatgattaaactgcagccgcagaacaaagaacttgacctgcttattgttattcttccagataataatggctctctttatggtgatttgaaaaggatttgtgagactgatcttggtattgtttcccagtgctgcttgactaaacatgtatttagaatgagcaaacaatatttggccaatgtggcattgaaaattaatgtcaaggttgggggaagaaatactgttcttgttgatgcaatatcacgaaggatacctcttgtcagtgaccgtccgactataatttttggtgctgatgttacccatcctcaccctggggaggattcaagcccttctattgcagctgttgttgcctctcaagattggccagaggttacaaagtatgctggcctggtttgtgctcaagctcatcgtcaggagctcatccaagatttattcaagacatggcaggatcctgcaagggggactgtttctggtggcatgattaaggagctcttaatatctttccgacgagccactggacagaagccacagcgcattatattctacagagatggtgtcagcgaaggccagttctatcaagttctattatatgaacttgatgctattcgtaaggcatgtgcctcattggagccaaattatcagcctcctgttacatttgttgtggtgcaaaaaaggcatcatacaaggttgtttgctaacaatcataatgatcgccgttctgtagacaggagtgggaatattttgcctggcactgtggtggactccaaaatttgtcacccaacggagtttgacttctacttatgcagccatgctgggattcagggtacaagccgtccagctcattaccatgtgctatgggatgagaacaagtttacagctgatgcattacagtcccttacaaataacctttgctatacatatgcaaggtgcacacgatcagtgtctattgttccccctgcgtactacgcacatcttgctgcattccgagctcgcttttatatggaaccagaaacatcagacagtggatcaatgacaagtggcacagctgcagggcgtggaggtggagctgcagctgctggtgggcgtagcacaagaggacctggtgctagtgctgccgtcagacctctgcctgccctcaaggaaaatgtcaagcgtgttatgttctactgttaagggagtgcttgtattttgagcatctgttttgttgggctttgcttcttggaatttcgaacaatatctagtatgtttggggttgcatggattattaaactaaacctgttgaaccttggtgttaaaactatgttaattttatgattattcgcttggaacattaaataaagaaatgtattgtacttgctgttcctttgctactaaagtaactttaaaacccaagttgttt

SEQ ID NO: 411 - DNA, 915 bp, Gossypium hirsutum
gagtggtatttgttatcttcatgggtaggaagaagagaagtgataatccttctgggggcgagagctcccagtctcatgatactggtgctggcagtggtcagggtccccaacgtcctcctcaacaacaagggggaagtggaggttactcgggtggacgaggttgggctccacaatcccagcaaggaggtcggggtggttatggctctggtggtcggggtcgtggaatgccacaacagcagtatggtggaggacctcctgaataccaaggtagaggaaggggaggttcttctcagcaaggaggtcgtgggggatatggtggcggtcgaggccgtggtggccgtggtggaggaccttttgctggtggaccatcccgaccacctgttcccgagctgcaccaagcaacccaacctatgcaagttgaggtgacccgccagcctgctccgtctgaggcaggctcatcatccaggccaccacctgagcctgtaccattggccgagcattttcaacagctttccatccagcaagaagctggccaagcaattcagccagtccctccatcaagcaagtcagtgaggtttcctcttcgacctggaaagggtagcactggcacaaggtgcattgtcaaagctaatcatttctttgctgaattgccagataaagatttgcaccagtatgatgttactattacaccggaggtagcatctcgaggagtgaaccgggctgtcatggagcagctagtgaaattatatagagaatcacatctaggaaagcgccttcctgcttatgatggccggaagagtctttacactgctgggcctctcccttttgtgtccaagagtttaagatcacccttaccgacgaggatgatggttcacgacagccaagaagagaccgggactttaaagttgtaatcaa

SEQ ID NO: 412 - DNA, 1459 bp, Gossypium hirsutum
taaaaacctcttattaaaattttaaacatataaataaagataatttattaagcttgatagatttgtctttctctatgtctctgttatggttgcagagagagccaaactgaatcaatctctaggcatttgcttctccaattccaatcttctttttcttttcttttttactaataagtcgtgagaaatgccagcaaaaccagggaatgatgatcagcagatagaccgtggggctcaaagtgtgttgcagtcaactgcctactctgaaccctggtggaaaggagttgggactaacccctttggtgaagctgcctcgaagtcgccttctgtagaacaactaaatggttcagtggcaaatggagatgtgcattcacaggctcatggggacttgggcaatgaagatgggagaaacggacaagatcgccaacatctcaaacacgttccttccacaacaccccttactttgggtgaacaccatgaaccaaattcccaaatggaactagttggtcactcgattgtcttgacatcatatccttattcagatcctcagtattgtggaattctgacttcatatgggccacaaatgatggtgtcaccacatctatatggaatgcatcatgctagaatgcctttgcctcttaaaatggaagaggagcctgtttatgtaaatgcaaagcaatatcatggcattttgaggcgaagacagatacgtgctaaggctgagcttgaaaagaaagccattaaagttagaaagccataccttcatgagtcccggcatctacatgctatgagaagggctaggggttgtggaggtcgttttcttaatacaaagaagcagggtgatgatgttaccagccccacttcacaaaagggcatgaattcagatgaaaacatttcaaccaaatcatctatcttgtctgggtctgagtgtgtatccgcaactggtgctggaaacatgaactccttctatggtcagcaagacccacgcgtccgcccacgcgtccggcaagggaacggggcgcaacatggggccccttcaattaaatgaaatttatccttgaggcagtgctggaggtatttgccctggatcttgggtgtctgaatccctcctggagtggtgttcctcaggcaattcattcttggctttggttactcatggttaaaggggttattatatgagaagataagtgctctttggttttttatctccactctggtaatagctttgacatgcctccctttgacccttctgtaaaaaaagaagataaaaacaggtgttgtatctaggcagtagcaaacagttgtgaatgtgcaaaaatttcaaacaaatttacattaatttgagtgtcaaagggcttggagacttgtgtatgagtgaaagagcttcgaacttttccataagtgtggccttaataatgtaaatgccgtctgttgtttgtttctaaaaaaaaaaaaaaaaaaa

SEQ ID NO: 413 - DNA, 1945 bp, Gossypium hirsutum
tttgtttagtctgtgatgatctctttgtgtctgctttattgatctctttaaagatttttgggtttatttttcttttaacttgattcatctttgttgtttagatatggggtttttgagtttcttttttctttttttgtattttcaatgatttgaggatcggcaaagatcttgtatttatttttgctaatgttaaaattcgagtttcagattcgtttacgaagatataaaccaactgaattaaattctagattttttttacttttagattttatttgtcttcgttagattttgccttttgaagttaaaattcgagctttaaatttgctaaatgctaatgatttttaactgtgattttatgaatcaactgaaaatagattctgggtttattttaaaatttaataaataacttagtttctagattttttttatatggtttttttagtaaaattctgtgataattgtttgatttgttgtttaattttgtaggaaaaagagtttgaataattgaaacataatgcaaactctgcatcttaaagaatatggtgggattgggaatcatccaatgggacaactggcctcagttccaccatcatcattgccaacactgccatggtgtagtgttttaggatctcatcaatctctacatggaggggaggcttttggtgctcaattgaagccctttttaatggaacatccctctaatggtgaccaagttctttcatccaaacaactgaataaagggaatactgctcaattcactattttcccaggtgattgcaaaaattcaggggatgagcataataaacctcaggcagtcacctctctgcaatcagatccttcagaaaatggtgctcgctttgaactgggatttggtcagcacatgttgcaggcatctgcaaaatatccttacatggatcaattatatggagttttctcaacttatggagctcaaatttcgggtcgtgtaatgctgccattgaacatggcatccgaagagggaccaatatatgtaaatgctaagcaatacaagggaatcatgaggcgtcggcaatctcgtgcaaaggctgtgcttcagaataaattgtctaaagctcgaaagccatatatgcactactctcgccacctacacgcaatgcgccgaccaaggggttgtggtggccggttcctgaatacccgaggctcaggctccgacaaagacgacactgcaacaaagaaagccactcaaggactgatgtcgaaccgttcctgttcatccgatagtggaaccttgaactcatccaagggaccaacacattcagggtcctcagaggtcactagtatttactcaaggagagaccttgatcaccacttcctaatcgatcatcttggattatcagtccactctatctcatcgatgatcaataatcaacgtggaggcacgattacagttgcaacggcagacaactgttgcaacctaaaagtttgatatcaatggaggggaaaattgtgggatttggtgctacctttttgcaccaaaaaaacaccgcttttcccctttagcaatcaatggaagtaacttggttttgcaattaactgttacagggtcttttgcaatacaggttttggttgctaggcaaatcattcttggctcaacttaagtaagctcttctttaccaatggttgaagatgctgaaacttcaaaatatatatatggatcagactataaaatggggtgtttccatttgatccaatgataagctttgaaagtttggttatggtgtttgtaatcttaaatttgcagaatttgtggtggatgattatggtgtggtgctgttgtgaaaataatgtactgtaaactttaatataatgtgtgtttcatgtttggattattattttcttttatgaattattattttctatataaactattaattttttttaatttcaaaaaaaaaaaaaaaaaaaa

SEQ ID NO: 414 - DNA, 989 bp, Gossypium hirsutum
gctaatgaaatccaggtgtcacacatctatatggaatgcatcatgctagaatgcctttgcctcttaaaatggaagaggagcctgtttatgtaaatgcaaagcaatatcatggcattttgaggcgaagacagatacgtgctaagtgctgagcttgaaaagaaagccattaaagttagaaaggtaaaaatggtattcttttagggggctttcccccccatttcttgtttagtggtgcctgttagaaatgataggaaggttcaggactcaactctgttgccattgactacagccataccttcatgagtcccggcatctacatgctatgagaagggctaggggttgtggaggtcgttttcttaatacaaagaagcagggtgatgatgttaccagccccacttcacaaaagggcatgaattcagatgaaaacatttcaaccaaatcatctatcttgtctgggtctgagtgtgtatccgcaactggtgctggaaacatgaactccttctatggtcagcaagaaggaaattgtgcaagggatatcatgcaagggaacggggcgcaacatggggccccttcaattaaatgacatttatccttgaggtgggtggcactctccagcattgctgtgcaggcagtgctggaggtatttgccctggatcttgggtgtctgaatccctcctggagtggtgtccctcaggcaattcattcttggctttggttactcatggttaaaggggttattatatgagaagatatgtggtttttggttttttatcttcactctggtaatagctttgacatgcctccctttgacccttttgtaaaaaaagaagataaaaacaggtgttgtatctaggcagtagcaaacagttgtgaatgtgcaaaaatttcaaacaaatttacattaatttgagtgtcaaagggcttggagacttgtgtatgactgaaagagctttgaacttttccatcagtgtggccttaataatgtaaat

SEQ ID NO: 415 - DNA, 1452 bp, Gossypium hirsutum
aaggttgcatagatagagcgcaaaatcgaccaatctctgtgatctttgcttctcaaaatcaaatcctttcagcccctcttccttccatgcttttcctacagggctgggcttctgattcccagagtaaagtagtgaataatgccagcaaaaccgcggaatgaagatcaacggatgcaccatggtgctcaaagtgtgttgaactcaactgcctccttggagccctggtggaaagcagtagggattgacctcttaggtgaagctgcttcaaagtcaacctctgcagagaaaaaaaatggtccaacagcagatggagatgggcgaaatggacatgatgaacaatatctcaagcatgtcccttctgcagccctcaagcatgtcccttctgcagccccccttacattggttgaacaccttgaaccaaattcccaaatggaactagctggccactcaattgtcttgaaatcttacccctgttcagattcgcagtacagtggaatactggcttcatatgggccacaaataatggtgtcaccactatatggaatgcatcatgctagaatgcctttgcctcttcaaatggaagaggagcctgtttatgtaaatgcaaagcaatatcatggaattttaaggcgaagacaaatacgtgccaaggctgagcttgaaaagaaagtcattaaagttagaaagccataccttcatgaatcacggcatctgcatgctatgagaagggctaggggtagtggaggtcgttttctgaataaaagaagctggatgatcacatcaccagtcctaactcagaaaagggtatgaattcagatgaaaacatttcagctaaatcagcttacttatctgggtttgagtgcttatcttccagtggtactggaaatttgagttccttctacggacagcaagagggaaatgtgtcactagttaaggatttgcatgaagcacagcctttaagtaacggtacaccccacttatcatctaatgatgctgagacgggtaactacttccaccagcagagggatatggtgcaagggaatggggcacaacatgggtccccttcaattaaatgagattccttcttgaggcagcgctggaggtatttgtcccttagatgttgggtggcggaatccttcccagagtggcgtctctcaggcaaatcattcttggctttggtttggttaaggggttatcatatggggaagtatgtggtctttggttttatccacacactgctgttcctcctattgatccctttgtagaaagataatgtgtggtatcgtgctacctacaaaagtgtataatttgaaacaacttatattagaacttgtgaactgaagcagaacttacgtatgactaaagagttttagcatttacatgagtgtggccttaataatgtataaatgcttcctgctgttgcttctcaaataaaaaaaaaaaaaaaaaaaa

SEQ ID NO: 416 - DNA, 1410 bp, Gossypium hirsutum
ggcacgaggcttatttattttctctctcaaaaaatccccaaaatctagggttgttgtttttgttcttctttgttaaaccgagaataagaaattgactatcatttgagtgtattgggaggaatgcagtcgaattctgaagaaggaagtcgattagaacctgcagtgcatggtgttcatccaactgcagtttattctgaacccaagtggcgtaatactggttatggtgccatctccccgggagtgagaggagtgaactcattaaattcatcttcgatggaatgcactaatgcatcagagtcgaatgatgggcagtcactgtccaatggtgcactaaatgaagaggatgatgttaataaagaaacacaaactactgcatcctctcgggcagttggaactggaggacaagaacatcacaatttgcagcatgttggatctagcatgcctgctgtgcgtgatgaaggcctcacccaacctcccctgcttgagcttgttggtcattcaatcgcatgtgcatcaaatccttatatagatccactttatggaggaatgatggcagcttatggacatcagcctatgggttatcctccgtttgttggaatgcctcatgcaagaatgactttgccgattgaaatggcacaagagcctgtttatgtaaatgccaaacagtaccaaggaattctcaggcgaaggcaggcccgtgccaaagcagaacttgagaagaaggttgttaaatcccgaaagccttatcttcacgaatcaaggcaccagcatgctttacgtagggcgagaggtagtgggaggacgttttgcaaagacaacagataccaatccaggagaagaaaaaggatcaggttcaggtcccacgttatcatcccaatctccaagttcctccggttctgaaccattacaaactgattccaacgaaacctggacctcctccctcacccagcatggcatccaccatgtcaacggcggcagccattatcagaagctaggtggtaacatctccaatcaggccgctttctatccggtgaatggaggacaatcctttcaaaagctgaagggttgaactccagagacggttacagtcatggcaatgcattagcgaggcggcaaatcattcttggcttcggttatatggaaggggagaagagattgtacgagacccggacatcgttttcgtcttgtccatgcttcactataatttttcccaaagctgcatttttgtaaatataccgttgaatagaactgaaaaagtaagtagttaaattagtagagcttgtgagaaatatttgataagtagtagattgcacccagggctttcattgtcgttttaagttaaaaaacaaaacatgtttttgtagtttggattagcagttttttttataatggggcacctttttaaacgtt

SEQ ID NO: 417 - DNA, 1495 bp, Gossypium hirsutum
gtgcttttgaggaacaaagagaaacagagtttttcctttccctttttctttggtaaatattttgtttgaaagggaaggaagagacatgcacaaatccaagcttagaagaaaattcttcatgagtgttatttctctttcagtttaacaaatcccaaaggtcactgatgtgcaagcacgttaacatatagcagcaaagatttcttcttagcactttcaaaatctctcccggctccttttataagtcaggatgcattgaagtttgaatggtaggttgccgtaatgcaaaccttgcataaaaaggattgtgtgttaagttctcatttgacatgcacgaacgtagttggctgctcatcttgggtcaactcaatggaatctcatgtccagcaatcatccatgtctgaaagtttaaacttgaagatgggaattgtacctcaacacttccataactccaagcagctaagttttcaatttcaagaccaggactcatcatcaactcaatcaactggccaatcttaccctgaagcggctagtgttggagatagcaatctttataggcaaagttcaatttcagcatcatcaggaggtaatgaaactcccgggaagcttgttgaacatcatgctaaattagcctcctcaatgggaacccaggaatatgtcttctctccttcacaagttgactatagcattcccgcgcccgctcatattcccctccattgcgctgaaccgtattttggtggtgctgtgactgctgtttgcccacctccagctatgagtcatcatccttgtatgctagcaatgcttcctgctcgagttccacttcctttggagcttacagaagacgaaactatttacgttaatgcaaagcagtatggggctattctcaggcgaagacagtatcgagcgaagcttgaggctcagaataaactgatcaaagttcgaaagccctatctgcatgagtctcgacatcttcacgctttaaaaagggctagaggaaatggcgggcgattcctgaacacaaagaagctccaagaatccaagccgattccaacaagccatggacttgatgcatcaaggtctcctcagctacatttgtgtgcaaacatgtcgaatcagctggaaaattacaaagacgctgcttcaactaccacttgctctgatgtcactagtgcctccaacggtgatgaaatgctacagcagcgagatttcaggttctctggctattcttctctcattgctggagccatgcgggggagtggtgggaacctccatcatctttctggttgcggctgatagattatggtgggagcactgcagtccggtgcttcaatgaaagatacggctgctttgttccggtgggaagtcatccttggctcagtttgtttatttttaataatagacttgactgttacaaaagcatgaacatgaagttatttcttggcagaacttgattgctatttggtgtttatgttagacaataatgcatgccttggttgct

SEQ ID NO: 418 - DNA, 1008 bp, Gossypium hirsutum
gtccactcacgcgtccgaacggaactcatgggaagcttgtaggaaatcatgctaaattagcctatgtaacgggaactcaggaccatgtctttcctccttcacaaggttatagaaaaccaatcgttcacattccacaccattatgccaacccatactttggcagtgtagcggctactgcttatggatcacaagctatgattcatcatgctcatatgatggctatgcttcctgctcgagttccgctgccactggatcttaaagaaggtgaaccgatttatgttaatgcaaagcagtatcatgctattctccggcgaagacaatatcgtgcaaagctcgaggcacagaacaaactcataaaagttcgaaagccgtatatgcatgagtctcgacatcttcatgcgataaaacgagctagaggaagtggtgggcaatttctcaacacaaagaaactccaatccaaaagcactccgacaagccacggaccggacatgtccaggtctcctcagctgcatttgtctgcaaacatctctgtaacagatgttcatcagccagaaaatttcaaagattctggttcagctaactcttgctctgatgtcacaagtgcctccaacagtgatgaaatatttcagcagccagatttcaggttctatagctatccttccggtcatactggtgaagccatgccgggtcatgctggtcatatcctgctctcttccgatagtcgagcgaactgattcttgtccacgcagtctgtattcgatgatgctgcaatgaaaatacggctgctctgttcctctggggagtcatccttggctcggtttaattatatttggactgtcatcacagattgttacaaaaccaccaacaatattggtcaaaatctttaaaggcatcccttcccgtacatttgagcttgaatccaaaaaaaaaaaaaaaaaaaaaaaaaaaaacatgtcggccgcctcgtcccagtcgactctagactcgagcaagcttatgaatgcagtt

SEQ ID NO: 419 - DNA, 978 bp, Gossypium hirsutum
  misc_feature (25)..(25): n is a, c, g, or t
  misc_feature (28)..(28): n is a, c, g, or t
  misc_feature (33)..(33): n is a, c, g, or t
cccacgcgtccgcccacgcgtccgnggnaattngggttattttcctcaaaatccaatctttacttgggcacctgaaagtattggcctttatcaacaacttgaaaaccaggaaatgaaaccccagattctaaatcccccaaatcccaactttttcttaccatttccacaagaacaacaaccattaccaaagagactcaatcatggtcagatcccaaagctaccattctcagaccatgagttatttatcaaaaaacaacagcttgttgggtttcaagaacagaagccattaatggtgtctcaacaacaacaagcagccacattgttggaccagctttgtaaagtagcagagatggtagagactgggaatttctcacacgcgcaagggatattggcgcggctcaatcacttgtctccagtaggcaaaacatttcaacggattggtttttacttcaaggaggcattacaattactactcctcatgtataacaataccccagtctcgaaaaatccgacaccttttgatgttatcttcaaaatgggagcttacaaggtcttttccgaggtttcgccgttcgttcaatttgttaactttacgagtaaccaagctttccttgaagcactcgagaattccgaccgaatccacattgtggatttcgatattggttttggtgctcaatgggcttcttttatgcaggaacttcctatgaggagtaaaggagttgttccttcattgagaattacagcttttgtttccctttcgacgtaccatcctatcgaactcggtcttataagggaaaatcttgaacaattcgctaatggaatcggtgtaaattttgagcttgaggtacttaactttgattgtttagatcaaaacccttattcattgcctatgtttcgaatgaatgaaaacgaggcgcttgctgtgaactttcccgtttggtctgcttcgtatcgaacctctattttggcctattcggt

SEQ ID NO: 420 - DNA, 978 bp, Gossypium hirsutum
gacacagcaatgccatatatgtggcgaaggtcggaattaacccccaccaaaagcgacccaaactctggagctccgccgcgggtggggccgcgtgaaagacagaggggagcccccggcgcccgaggattggggccctaggtgaagttcccaaccttaactcaggttgggggaatcgaaacccgaaacccaaccgacaacacagaagaggggctaaacctaatgctgataggcaaagtggtacgagttatcagcagcatagtctcccacttgaagcaactgattggcaatgtcggggatttaggtctatgcaggaatctcgtagaattgatgaagctggccatggatatagtgaggaagaaacaatgcagttgttgagccaaactcacattcactctccagctgtctcagttaagtgtaatgaaatgcaaagatatggacagatgaggagacctggaggcaacagtaacatgtttcacattgttcctcaacacattaatccatcaccttatcagattcatattccaagaagcagcaatggagggcgaattgggagtgatctttcattatcaactagtgatcaacagtggcaatcaggtcctcaccaccagttgtttggaaattctgcagcatcatcaggattcccatcgcagatcagaccttcccaaacatggcttcaccaaaatggcttccattcactcatctaattcttcactaattaaaattctttacatgcctttctcatatatcatccttttttattattattaataatatctagatgtatagaaaaacaattccaaccttgttgaatatatatttatatatatgatgttcttctgactttttttctttttttttttttctcgtctttaatgcattgctttgccgccctacacagttggtattattattgatttaataaaaccccccattgtatgtatatgtaactttatcaactatcatcattaaatgtttctt

SEQ ID NO: 421 - DNA, 1039 bp, Gossypium hirsutum
  misc_feature (223)..(223): n is a, c, g, or t
gcgcccacgcgtccgaccacgcgtccgcccacgcgtacgcacaaatgcggcaggtgggaagcacggatggggcagttcctaggcaaaagggcttatgacaaggcagctatcaaaagtaatggacgggaggcagtcaccaactttgagctgagtacatatgaaggggagatggtctttgataccaggaacaaaggcaatggtcacaaccttgatctgaacctgnggatatctccacctgttagcgatggtcccaaggaaaaggaaaatgcggggcatctccaaatgaataacggaaagagtttaagggcagagaaccctgcagctgcaacatttagtgttccatctttccaagggttagcggggacttcagatcagcctattttctggaatagtgcatatccgagattcttccctagtgaggctccacttccaatattctttcctaggaaagaacaatggtgaaaccggttgaattcaatcctccacaacgtgtccctgattggcggaggcaaatgcacggtcatgtcagtactacactaatgccactgttctctcatgcagcatcatcaagattctcattctcagctacccctccttcaaccgccactgccattcttccatccaaacctcaaaacacaacagcagtccacagtctatgttttgctgcctcaaccagtaacaccatcaacacccctcaacatagtcgatcgtaagttcaattgtaccacaacgacggcgattacaataataatttaaatattgattcaatatacattaagacatggtagtttctgacttggtccgtgaactaaaaagagtatctactctctgtctagcattaaggcatgtaggaccacaactttcatatatgatcttatgtggtgcataaaggcatatcatcaggaacttgttcagtgcgtttaaactttttttttttttcatttcatgtagattagaaagcagattccattaaggtaaaatttgattcttttggtacaaaaacctgaaacaggaaaagtccttttttttttttctataa

SEQ ID NO: 422 - DNA, 979 bp, Gossypium hirsutum
cgtccgtttttttgtgaatacagatatgtctttttaggcttgtttgataccgagattgaagctgcaagggcttatgacaaagctgcaattaagtgcaatgggaaagatgctgtaactaattttgatcctagtatatatgataatgagcttcacaacggtgaaacatcatcatgtaatggtagggatcacaaccttgatttgagcttagggaattcaacttcaaagcaaaataatttagaatttggtggtgttgataagcaaaatgcaatggtggatcaacatagttggggctataggtctaagcaaaatctgcagcagggacctgggggaaatgaggatacaatgcagcttttgaaccaaacacagattcaatattctcaagcttcaattaagtccattggacaacggaacagacctactgataaccatacgttcaacattcatcctccccattttaatccgtatcggattcattatccaagcaacaacaacaatggagttcaaatagggggggatctttcattgtcaactaatgatcatcatcatcaacaatggcaatcaacgggatctccccaactgtgtttacaaatggggcagcatcatcaggattcccatggcagactagaccttccaaagctaagaaaaatgggttccactccctcatgagaaaagcactatacacaccatattttatcatcccccattgttggttaatctctatgtatagatcaatgcattgagttgcactccatttttttttactcaatttttttagttaacccatagggaaaattacaaaaattattccccccaaaaaagaggagagaaaaaagaagcattattggtcaaaatcactaacaaagcaactaaaacaaatgatcttttccattgtcttcaataaatttgctttgccttcttatgtattgcattagtgtaattttcatttatataaaatatcgatcatggaaatctttatgtt

SEQ ID NO: 423 - DNA, 1521 bp, Gossypium hirsutum
gcacgagggttcagggttcccacaagctcactgggtgggcgtcagattctgtcaatcggagcctcacgcaccggaaaaatcctttgaagtagcacagccgatgaaaaaaagcaggagagggccaaggtcgagaagctctcagtatagaggagttactttttatagaagaaccggcagatgggagtcgcctcgctgggattgtggaaagcaagtttacttagtgtggattcgacacggcacatgcggctgctcgtgcatacgatagggcagcaatcaagttccggggagttgaagccgacataaattttagtatccaagattacgaggatgacttgaagcagatgtgtaacctaaccaaggaagaatttgtgcacgttcttcgccgacaaagcaccggatttcctcgaggaagctccaaatatagaggagtcaccttacacaaatgtggccgatgggaagctagaatgggccaattattaggcaaaaagtacgtttatttaggcttgtttgacacagagattgaagctgcgagggcttatgacagagcagcaattaagtgcaatggtaaagatgctgtcactaactttgatcccaggatatacgacaatgagcttaactgtggagaaacttcgggtaatgctggagatcacaaccttgatttgagcttagggaattcaacctcgaagcaaacgaatctggagttaggtggtgataggcaaattgctatgagcgatcagcacagtctgccacctgaagctgattggcaatataggggatttaggtctaaggtaaatctgcagcaggagccttgtagaagcgatggtgctactcatggaagatcggatggatatagtgaggcagaaacaatgcagctgttgagccaaactcttatccaatctccagcatcgattaagtctaatgaaatgcaaagatatggacagttcaggagacctggaaataacaatgtgtttcacattcctccatcatcttatcagattcattttccaagcagcagcaatggaggccgaataggaagcgatcttttactatccattagtgaacaacaatggcaatcaggtcctcaccaaatgtttggaaattctgcagcatcatcaggattcccatcgcagattagaccttcttctcaaacttggctgcagaaaaatgggttccactcactcatgagaccctcctaactcaaaaagtagccataaaaatgtctccgctaattaaaatatatatttctgttttctccttgttggctttgtaagtatgtcatttttaaaatccccccttcttttccctctacaactttctcggaaaatcacaaggaaaatcattggaagaagagggaaacttctgactctcttggagttgttgggcatcggtcaaactaacaaaccgacgaaaaacgttgaactatataaattccgggttctgacagaacagaaactgctaatctttttctatcgtctttaatgcaagttatatgccgcccgatacggttggcttcattgttgg

SEQ ID NO: 424 - DNA, 1989 bp, Gossypium hirsutum
gtattctgtaatgttctctgctctcatacgcccgtctcctctctctctctctctctctctctctctccctcctttgttcatggaatcagctagccggcgattatctttttccgtttattcgaattgatcgccgagtaattcatcaatggtagcatcatttttcaaattcctttgctttataacgacgctgttttcattctcctcggtctcccggaaagagagaatctccaaagtttttttttttgtaattcttagctttgtttcagtgttctgacagtatccatctcttcccgttggatttgataactttataggaaagaaaatatgattttgttttttgagctgaaaagttggtgattttttacttcaattttaaagggggtcaaagctaagttcggcaacaaacttaagacgaaatgctagatcttaacctcaatgtcgggtcgactgagtcggctcaggactcaaactcggcggctccttttagcaccgagcgtaatggagattgtggaaaccaaatggacgaatctggaacctcgaattcgtcgatcgtcaacgacgaggatgagtcgtgctccacgcgcgccaacggagatgcgttcactctaagcttcgacatactcaaagtcggaagtggtggaaatgagttccaaaacgacgacgcagacgtggtggttactagggagttgtttccggcgacgagagtcggaatttctgaagggcagagctcgggaaataacaacaaatggatcgatcatccgttcgagagaaaagaagctgatgagtcgcgggtaatacgtcaacaaccgtcacagacggcgaagaaaagccgtagaggacctcgttctagaagttcccagtatcgaggagttactttctatagaagaactggaagatgggaatcccatatatgggactgcgggaaacaagtatatttgggtggatttgatactgctcatgccgctgctagggcctatgatcgagcagctattaaatttcgaggggttgatgctgatatcaatttcagtgtcagtgattatgaggaagatatgaaacagatgaagaatctgtgtaaagaagaatttgtacacatacttcgtcgacaaagtactggtttttcgaggggaagctcgaaataccgaggagtcacgctgcacaaatgtggccgatgggaagcacggatggggcaattccttggcaaaaagtacatatatctcgggctatttgacaacgaagtagaagctgcaagggcttatgacaaggcagctatcaaatgtaacggacgggaggcagttaccaacttcgagccgagtacatacgaaggggagatcatctttgataccagtactaatgaaggcaatagtcacaatcttgatctaaacttggggatatctccacctgttggcaatgatccaaaggaaaatgagctgcagcatcaccacttccattctggtccccacgacttgcacgaggggaagagttcgagggcggagaaccctgctggtgcaatagtcagtccggctttcgaaaggctaaccgggaattcagatcaacctattttttggagaaatgtatatcctaggttctttcctagtgaggaaagagattgggcatggcaaatgcatggtgctaggccaacgccaccactgttgcccgctgcagcatcatcaggattctcgttcttggctacccctccctctgctgccattcttccctccaatctaacgactcccagtttccactttgccacccccactgccaccagtgccactcctcaaatctatattcacatggaggagccaccaccatagcctcattttgcaaccttcaccacgaaatgttgttaaggtattcaatacatgatttgtttacaactaataaggtttgcactggtttttattgattattgtgtgggtgatttgctttaaactgtgattttatatatatacaaagtttagtagtatattggaaaaaaaaaaaaaaaaaaaa

SEQ ID NO: 425 - DNA, 839 bp, Gossypium hirsutum
gccggcttttggccaaaacagccaattgttttctcagaggggaccccttcagtccagtaacacgcccttggttcgtgcttggatagacctgccaatttccacaaccgaccaacaccaacaccatcatcatcaacaacatcaccaccatcaaatcccagaaaacatccatcatcacactgctttatctggcgttggattcaccacacctggtgtattctctgggtttcgcgttccagcacgaattcagggcgaagaagatgagcacgacagcattgccaataagctgtcctctgcttcatctgattctcaccattgatcgagtaaatcggagaaaaggccaaaatctttcccctctatcagcactagttgattgttgactgtgaactggatgagaagataactatactatgatggatccaagaatcaaagactagttcgagggaagattttggtcaactttgaatcaatggcctataccgtgggaagaagaaatctgggtggatttcaggtttttcaatccccggtttgtttagtttctatcagttgattgtgttgtagcttaaatttatatttgagtgagctcttagagcttaacaatggtttctttttcttgttggacttgtcatgtttttcatgttaccaatcaatgtttgctactgtttcctagagttactattgagatgggaacatagtttgttctaatgctaatttgtttttccctccattttctttagatatattattttttttaatttgtggattttttctttttttagctttcttatttttcattttgtctgtgttttttttatttgttttctctttttttctaacttttt

SEQ ID NO: 426 - DNA, 1928 bp, Gossypium hirsutum
aagaggcccaattgggaaaagcttttagatagattgagagagaaaggaaggagaaagtaaagagatgatgggttagggtggggatttgaagctgtggaaggggccttatggtggaggggtcctttgtgataatggaaatggcagggccgacagtttcaggtttcaaggaacagtgagtacagaggctataaccagtgtccgccattaaagctgcaatacgaaaaccttctggatcctcaaaccaatcatcttcaccttcatttttcatttctaaattcaaccaattgaatctcaactacttcaacagcacctacaaacatccaagcttaacccaacatgcaagaagaatgggagaaagcaatcaccaagctgcaacatcgtcaagattggggttaaagcatagtggaggcgagatcgttgaggttcaaggaggtcacattgttcggtcaattggaagaaaagaccgtcacagcaaagtttgcaccgctaaaggtcctcgagaccgtcgtgttcgtctctccgctcacaccgccatccagttctacgacgttcaggaccgccttggttacgaccgtcctagcaaagctgtggattggcttatcaaaaaagccaaatccgccattgacgagctcgctgaactacctccttggaacccacaaaccttgaaaacaacgacttcaaccacgaaacaaaataatcaacaagatcaaaacataatcacagcagtagacaatgaaaagcccagaagaacggctacattaatgggaaaccaagttcaaattcttcagcaacaaggaacgggagataacccgaatagtaattcgggttttcttccatcttctttagtttctgatgagattgcagatactatgaagtcttcttttccattgggagcttccagtgaggcaccgtcttcttctattcagtttcagaattatccaccagattttttgtccaaaaccagcagccacagtcaagatctgcggctttcgcttcagtcatttccggagccggttcttctccaccaccatcaccaagctgctgcagctcaggcacatcaaactgaatctgttttattctctgcaggaaccagccctttagctggctttgatggatcttcagctggatgggaaaatcaccaccaccatccggctgaggtaggaaggcttcagagattggttgcctggaataatggtgctgctgctgctgatactggtagtggcggtggcggtggaatgggaggatttctctttggcaatctatcagcaccgccactatcaccggcttttggccaaagcggccagtttttctttcagaggggaccccttcagtccagtaacacgcccttggttcgtgcttggatagaccagccaattccaacaaccgacgaataccatcatcatcatcatcaaatcccacaaaatatccatcaccaacctgctttatctggcattgaattcaccacatcaggtgtattctctggatttcgcgttccagcacggttccagggcgcacaagaggatcaagacagcatcgcaaataagctgtcctctgcttcctctgactctcaccattgatccaataaaatggagaaaagccaaagtctttcccctctaacagtgaagtaaatgaggagatgctgctcgattcaacaccagtttgagggaagattttggtcacttcaaatcaatggcctatgccgtgggaagaagaaatctgggttgatttcaggttattcaatccccggttccattagtttctatcagttcattgtgttgtactttgactatttttttgactgagctcttaaaactcagctatggcttctcttcttgcagaacttgtcatgtgttttttatgttactggacatttgtttgcaatgtttatgttgattgctactgttccctaaaaaaaaaaaaaaaaaaaa

SEQ ID NO: 427 - DNA, 1775 bp, Gossypium hirsutum
ccccgcgtccgggtatgatggaattagaatcattgaatggcagtggcttttgagagaggtcacagtatcaggtttcagtgtggtggcagtagcttatacagggagaggatattagcaagcaaagaacaactacaacccataacataaaaaagtatcctccattaaaagctggaacagcaaaagcaccagagcctgactctggatcctcaaaggcatcatcatcatcagcagcagcagcagcaacatcagaatccatctcatatagaaggaggagaagaagaagaaattccgaggaaccaacagcaaatcttgtttctccatcatcaacaacagcaagagcaacagttgtatgcaagactggaaactcaagtactacgagagcagcaagggcaacaacaacagcaagagtacccacaaccacccaagaaacgctcttatctgccgtcggcttctacttcaacttttggttccaaatcaacccaacatgcaagaaaaatgggagatagccaccaccaagctgcaacatcgtcaagattggggataaggcactctggaggggagatcgttgaggtccaaggaggtcacattgttcggtcaactggaaggaaagaccgtcacagcaaagtttgtactgccaaaggtcctcgagaccgacgtgttcgtctctcagctcacaccgccatccagttctacgacgtccaggaccgacttggctacgatcgtcctagcaaagccgtggattggcttatcaaaaaagccaaacctgccattgacgagctagctgaactacctccttggaaccctgaaactttgaatacaaccacttcgatcgctaaaactagtaaccaagaagaccaaaacgcgacaaccgcaaccgacaatgataagccgtatcagttccacaccaaccatagtggaaacctggtggaaaaccttgctgctgggtcgcgtcctcggcctggtgcggctacattaatgggaaatcaagttcaaattcttcagcaacaagaaatgggagataacccgaatagtaattcgggttttcttccatcttctttagtttctgatgagatagcggatactatgaagtcttttttcccattgggagcttccagtgaggcaccgtcttcttctattcagtttcagaattatccaccggattttttgtccaaaaccagcagccacagtcaagatctgcggctttcgcttcagtcatttccggagccggttcttctccaccaccatcaccaagctgctgcagctcaggcacatcaaactgaatctgttttattctctgcaggaaccagccctttagctggttttgatggatcttcagctggatgggaaaatcaccaccaccatccggctgaggtaggaagtgcttcagagatttggttgcctggaataatggtgctgctgctgctgatacttggtagtggcggtggcggtggactgggaggatttctctttggcaatccatcagcaccgccactatcaccggcttttggccaaaacggccagtttttctttcagaggggaccccttcagtccagtaacacgcccttggttcgtgcttggatagaccagccaattccaacaaccgacgaataccatcatcatcatcatcaaatcccacaaaatatccatcaccaacctgctttatcttggcattgaattcaccacatcaggtgtattctctggatttcgcgttccagcacggttccagtgcgcacaagagtgatcaagacagcatcgcaaataagcttgcctctgca

SEQ ID NO: 428 - DNA, 588 bp, Gossypium hirsutum
ttacataggaatgtatgccgagcagctcgagatgctgtccatcgcttttgctgcagacagtgacaaaggaatgctctacgtgttgaatggttgcaagaaacttcgcaagctagagatcagggactgcccctttggtgacgcagcacttctagaggacgtgggaaagtatgaaacaatgcgatccctttggatgtcctcctgtgaagttaccctcggaggctgtaagtcagttgctgagaagatgccgagcctaaatgtggagatcatagatgagagtgaacaaatggaatttaaccttgacgacaagcagaaggtagacaagatgtatctgtatcgaacattagtcgggcataggaaagatgcaccagaatatgtgtggattttgtaggtgcattggtttggctcagccattatttatctttgcttatttaagtagttgtacgttgttaggagaaccccgattttaatgtattattagcttgtggtgatctagcctttatgctattgttgtttgttatttataaatagatttgttttaagtaatccttgttatttataaatggatctgttttaagtatttttcagaat

SEQ ID NO: 429 - DNA, 1494 bp, Gossypium hirsutum
gcacgaggggagctggatttacaagaaaatgaagttgaggatcatagaggccattggcttagttgctttcctgaaagctgcacatctcttgtctccctcaatttcgcatgcctcaaaggagaaataaacttagcatctctcgaaagacttgtggcaaggtcgcctaacctcaagagtttgaggttaaaccgcatggtgccgcttgatacgctccaaaaactgttgatgcgagcaccccaactggtggacttgggtattgggtcttatgtggatgatccatcttctgaggtcttcagcaaactgaaaactgtcattcaattgtgcaattcaatcaggagtttatctgggtttttggaggttgctccttgttgcatgtcagctatttatcctatttgcgaaaacctgacattcttgaacttgagctatgctccgggtcttcaaggtaatgatctcacgaagctggttcagcactgcaggaaacttcagcgtctctggatactggattgtattggagacaaaggactcggagttgtagcttcaacttgtaaagaattgcaggaattgagggttttcccatcggatccatttgatgccggaaatgctgcagtgacagaggaaggtttggtccttatatcatcaggatgtcctaagctcaactcattgctgtatttctgtcatcagatgacgaatgctgccctcatcactgtagccaagaattgcacaaattttatccgtttcaggttgtgcatccttgaccccgtaaaagctgaccctgtaaccaatcagccattggatgaaggttttggggcaattgtccggtctaacaagagtctgaagcggttatcactctctggccttctgactgatcaggtttttctttacataggaatgtatgctaagaagctcgaaatgctgtccattgcttttgccggcgacagtaacaaaggaatgctctacgtgttgaacggttgcaaaaaactccgcaagctagagattagggactgcccctttggtgacgtagcacttttacaggacatgggaaagtatgaaacaatgcgatccctttggatgtcctcctgcgaagttaccctcggagcctgcaagaccctcgcaaagaagatgccaagcctgaatgtggagatcataaacgaaagtgaaaagttggaaagtgaacagttggaatttagcttcgatgataggcttctggtagacaagatgtatttgtatcggacattggtgggggataggaaagatgcgccggagtatgtgtggcttttgtaggtgcattattttggctcagccgttttcatttctgttttgttaaaactagagtactactttgttagggacaattttattttcatggatctagctggtcggtgatctagagatgtatgctacctttgtttaatttacaagagatttggtatttgtagtccgcgttcctccccgctggcttcctttccagcaatgcaatgaagtttgtggattaag

SEQ ID NO: 430 - DNA, 2430 bp, Gossypium hirsutum
aacttatagttgttaaagattcttcagatctatgtaaattttatggatttttttgggtatttgccttttttttcttctcctttttaaactgtaatgtaattatagttctttgatttttgaagatgatcgtgggaaagaatctattttcccttcattttcactacagaaaaaaaatctcttttattttttctcgagagaattcgagttccttttcactctctttcacttcggttcttgaaagagatgtgagtttttaaagaaaaagcttattttattttattttaaatttccactatgagtcttaggtaaaatcttcagatctggtgaattcttgtggatttcatcaagatctctgccttttcatgtagggaattcttcattttttttcccttttttttccttcttttccctggttttctcgggagaaaggaaaacaaaaaaagaaagtaaaactgtgtatgttctggtgggggaaagtagtaaaacaataaaagatgaattatttcccagatgaagttttagagcacgtgtttgatttcatcacatctcacaaagaccgtaactcagtgtctttagtttgcaaatcgtggtacaaaatcgaaagatacagcaggcaaagggttttcattgggaactgttattccatcagcccagagaggttgatcgccagattccctggcttgaagtcgctgactttgaaagggaagccgcatttcgccgacttcaatttggtgccacatgattggggaggtttcgtttatccttggatcgaagccttggctaagagccgaatcggattggaagaacttaggcttaagaggatggtggtgtctgatgagagcctcgagctgctttccaaatcatttgtgaattttaagtctttggtccttgttagttgtgaaggcttcactactgatggtcttgccgctattgctgctaattgtaggtttcttagggagctggatttacaagaaaatgaagttgatgatcatagaggtcattggcttagttgctttcctgaaagctgtacctctctgatttccctgaattttgcctgccttagaggagaagtgaacttaggagctcttgaaagacttgtgtcaagatctcccaacctcaagagtttacgactaaaccgtgcggtcccgcttgataccctccaaaaactattgatgcgagctcctcaactggtggacttgggaatcgggtcttatgtacatgatccattctctgaggcctataacaaattgaaaattgccattcaaaggtgcaaatcaatcaggagtttatcggggtttttggaggttgctcctcattgcatgtcggctatttatccgatttgtggaaacctgaccttcttgaacttgagttatgctccaggccttcatggtaataagctgatgaagctgattcagcattgcaggaaacttcagcgtctatggatactggattgtattggagataagggactaggagtagtggctttgacatgtaaagaattgcaggaattgagggttttcccatctgatccctttgaagctggaaatgctgccgtgactgaggaaggtttggtcctagtatctgcaggctgtccaaagctcaattcgctgctgtacttctgtcagcagatgacgaatgctgccctcataactgtagctaagaactgcccgaattttatccgcttcagattgtgcatccttgaccccataaaacctgaccctgtaaccaatcagccattggatgaaggttttggggcgattgtccagtcttgcaagggtctcaagagactatcactctctggccttctgactgatcaggtttttctttacataggaatgtatgccgagcagctcgagatgctgtccatcgcttttgctgcggacagtgacaaaggaatgctctacgtgttgaacggttgcaagaaacttcgcaagctagagatcagggactgcccctttggtgacgcagcacttctagaggacgtgggaaagtatgaaacaatgcgatccctttggatgtcctcctgtgaagttaccctcggaggctgcaagtcagttgctgagaagatgccgagcctaaatgtggagatcatagatgagagtgaacaaatggaatttaaccttgacgacaagcagaaggtagacaagatgtatctgtatcgaacattagtcgggcataggaaagatgcaccagaatatgtgtggattttgtaggtgcattggtttggctcagccattatttatctttgcttatttaagtagttgtacgttgttaggagaaccgattttaatgtattattagcttgtggtgatctagcctttatgctattgttgtttaatgtacaagagatttgctattttgtaatccttgttatttataaatggatctgttttaagtatttttcagaatcaaaaaaaaaaaaaaaaaaaa

SEQ ID NO: 431 - DNA, 1429 bp, Gossypium hirsutum
gcggccccttcggcggccggcctccctcaacttttattactccactaagtctaacaatgacaacattaagtccactagatgattactacccccaaaataaaaggcgacagaaatccataaacatccaaaattctataaattgtattagatggtaacaatggggaaacaaataaaacctttgattgattacacaacaaccggagtttccatctttttattaattttttacgtggtgtacccgatagctcaggcaagggcgacacgtatggcaatctagctctcaaagccttgaacagcctccatattatgttcccactccaatcatgtctgcgccattatattaggctgcataaaactgaaccgggaacaatgagtaacgcaatgaacatgtacctgagacattcattcttgagatcaatcgagctgaatccaaggaaatttctcatgaaagcctcaatccagaatcttcatccattgtccaaacaaaaggaggcatgtcgaaccttggccctgcaatggacctatatatgtagagcttatcaactgggcagttctctggtcttgaatcaggaggtcccctctcatctataacttcaacattcaaccttggcatcttctgacctagcagcttacatgctgcgaagctcacagcgcaagaagacatccaaagggatcgcattgtctccagctttgcagcattggccaaaagagccttgtcaccaaaggggcaatctctgatctccagtttccgaaggctttcacacccggaaagcacatgatgtagtcccaaatcactatctcctgcaaaagccacagacagcatctcaagcttcttcgcgtatgtcccaatatattcgaatacacgatctgtaagaagaccagagagggaaagacgcctgagatccttgcagtactgaacaatggctccaaaaccaacatcaagtggctcgagagtcaggtaatcagctgttttaggctcaattatacaaaggcgaaaccttgtgaagtttggacggctacgagcaatggtaactaatgcctcattagacattcggcggcagaagtacaatactgattgtagcttgggacaacccaaagatacggcaacaaggccctgttctgtcaaggacacatttggctctgcaccaaatggatcagatggaaacacgcgtaattcttgcaagtccttgcaactagatgcaagcacctcaagcccactatcttcaatgtaatcaagtaccgaacggaataggcgctgcaaattcggacagtggcttacaagcttgataagatcaggactttgtatagtagcatagctcaggttcagtgatgttaatttagagcagacagggtaaatggcaggaaggtaatccgggatcacatcccaaaatccagacaagctctttagttccttgcaactagaaagcac

SEQ ID NO: 432 - DNA, 1089 bp, Gossypium hirsutum
gtcaaatgtctaatgcagctttagtcaccattgctcagaactgtccaaacttcactcgttttcgtctttgtcttcttgatccaaaaatagccgactaccggacccttcagccacttgatgtaggttttggagccattgttgagcactgcaaggatctgagacgcctttccctctctggtctcctcacagatcgtgtatttgaatatatcgggatgcatgcgaaaaagctagagatgctgtctgtggcttttgcaggagaaagcgatttggcacttcatcatgtgctttctgggtgtgaaagtctccggaaactggagattatgaactgccccttcggggacaaggctctattagcgaacgctgcaaagctggagacaatgcgatccctttggatgtcttcttgctctgtgagtctcggagcatgtaagatgctaggtcaaaagatgcccaggttgaatatcgaagttatggacgagaagggacctccagattcaagagcagaaagtgacccggtcgataagctctacatatatagatctgttgccgggccgaggttcgatatgcctccatttgtttggacgatggacgaagattttgcatcagagctctcttgagaattaggcaacatgttagtaaaaactcttttaatctcaagaatcaatgcatcaggtacatgctcctttatgttactcattattcccttagcttaatctaattgcagaccttattgaagggtgtaaaatggttttgagctccatcgcctttcgttttagtagtggctggcggagccatcggaaacacaatgatcaataaagagatggaaactccagttgtggattaatcaagagtttttattttattttatttgtttcttccccatagttgccatgcgtaatgttggatgtttatgccatttgtattatctttttgggggtagtaaatcttaattattatctgttctctcaatgctcaaattatgttttggtcccttgactaacctcattgactctgtatcaaagctttaggttcttaagtattttcgacccttaaaaatgatgtattcattagcccttcatatttttgttagaa

SEQ ID NO: 433 - DNA, 1081 bp, Gossypium hirsutum
gtttttgttgactacattagagcagcaatggcctccaccgcatgcttcttgcaccaccatgcactcacctccgcacccagatcatcatcaactccaccctccacatcccagcgccaagttgcaatcgtcaagtcaaatcaactgctggcttgcatttcacagaaacaggcagtccaagaaaatgataattcccgaagcagcgccgtgatctcccgtcggttggctctcactctgctcatcggtcctgcagcggttggctctaaggtttctcctgctgatgctgcctatggtgaagctgcaaatgtatttggaaagccaaaaacaaacacagagttcatcccatacaatggggaagggttcaagctgtcaataccatcaaaatggaacccaagcaaagaggttgagtacccaggtcaagtcctgagatacgaggacaacttcgactccaccaccaatgttgctgtcatggtcactcctactgataagaagtccattactgacttcggttcccctgaaaatttcctctctaaggtggactatctgcttggaaaacaagcatactctggcttaactgatgctgagggtgggtttgactcaaatgcagtggcaactgcaaacatattggagacttcaactcctgtgatcggagggaaacagtactacttcttgtcggtgttgacgagaactgctgatggagatgaaggtggcaagcaccaactaattacagccaccgtaaacaatggtaaactttacatttgcaaagcacaagctggggataagcggtggtttaaaggagctagaaagtttgtggagagtgctgcaaattccttcagtgttgcttagttaaaagtcttacttgttaactagagaataatttcatgtaaatcttgttagaaattatctgatgttggacctaagtttgtatattatcctactcccccttcctccaaagcttctggtttctgttttctgtttctgtttctgtctagtcgtcaggaaacttttggatatctgtatatatgtttcttaattggcacattatcaaggcggaaccctaatgaatattcctctttctaaaaaa

SEQ ID NO: 434 - DNA, 1793 bp, Gossypium hirsutum
gaaccaccaccaagaagaagaagaagaagaagaagaagaagaagcagaaccaaaccgggttttgttttggttctctcttccaatggcttccaccattttcatccaaccttcgtttacgtcaaagtctttgaataaatccctgaatacccatttcgtcccttccttcaaactccccggtttggtctctttcaagccccgaacggtttcccagttgtcggttcgagccgggttgatcgagccggacggtgggaagctcgtggacctccacgtggcggagccggagcgggggttgaagaagcgagaagcggctctgttgcccagggtgaagctgaccaggatcgacttgcaatgggtccatgttttgagtgagggctgggcaagccccctcaccgggttcatgagagaatccgagttcctccaaactcttcattttaattcgctccgactcggcgatggttctttcgtcaacatgtcggtgccgattgtgttggcgattgatgattctcaaaaggagaggatcgctgagtccaaaagagtcacgctcgttgactcggatgataaccccgtcgcgatcctcaacaacattgagatttataagcacccgaaggaagaaaggatagcgaggacatggggaactactgcccctggattgccatatgttgaggaaactataacaaaagctggaaattggctcattggaggtgatttggaggttatagagccgatcaagtaccatgatggtctcaatcgttttcggctttcacctgttgagttacgtcaagagtttgaaaaacgcaatgctgatgctgtgtttgcattccagctcagaaatcctgttcacaatggtcatgctttgctaatgaccgatactcgtcgtaggcttcttgagatggggtacaagaaccccatacttttgcttcatccattgggaggctacacgaaggcagatgatgttccacttagttggcgaatgaaacaacacgagaaggtgctcgaggacggtgttctcgatcctgaaacaacagtggtctctatattcccatctcctatgcactatgctggcccaactgaagtgcagtggcatgctaaagctcggatcaatgcaggggctaatttttatatcgttggtagagacccagctggcatgggccatcccattgagaagagagacctgtatgatgccgatcacgggaaaaaggtcttgagcatggcgcctggactcgagcggctgaacatccttccgttcagggttgccgcgtacgataagacccaaagcaaaatggctttcttcgatccctcgagagctcaagacttcctcttcatatcaggcaccaagatgcgagctcttgcgaagaacaaagagaaccctccagacggattcatgtgccctggcggttggaaagtgttggtcaaatactacgacagcttgacaccatccgacaacggaaggatccatgaagccgttccggcttagaccaatgtacgataaagatactccatatgattgggaggagcatatttaacactgtttgatttccaatgtgtgtgtgatgcagaatctctttaataaaaccatgagaggcactggtacagagacaatgaaaaaagcttgcctctccctgtaattaggttgcccccattatggtgtctgccattggtgctcgctttgcttgtgggcaacattgtactatttatgtctgtgtggtttgttttgttcttatgaaaagcaatggctatgggacatgctttaatgttttctcaaaaaaaaaaaaaaaaaaaaaaaaaaaaaaacc

SEQ ID NO: 435 - DNA, 1916 bp, Gossypium hirsutum
  misc_feature (1782)..(1782): n is a, c, g, or t
aatattcatagagaacacaacgcctttgtctcgtctctctcacggttcctcgaccaaatcaagctaccaaaggccaggctataaacagtacaccccaacgttgagtgttttattttttgattcaccgatcaaagctcttaacaatggcttccaccatcttcattcaaactccgtttcaatccaaatctttgaacaaatccttgaatacccattttgttccttcctttaaactccctgtttccctctctttcaaaccccggaccgctgccttctccaaacgcgtccatatccgagctggtttgatcgaaccggacggtgggaaacttgtcgacctccacgtgtcgaaaccggagcgggagttgaagaagcgggaagcggcttcgttgcccaaggtgaagcttactccgatcgacgtgcaatgggttcacgttttgagtgaaggctgggctagcccgttaaccgggtttatgagggaatctgagttcctccaaactcttcattttaactcgctccggctcgacgatggttccttcgtcaatatgtcggtcccgattgtattggctatcgacgatttgcaaaaagcgagtatcggtgagtccaacagagtcgctctccttgactcggatgataaactcatcgccatcctcaccgacattgagatttacaagcaccctaaggaagaaaggatagcaaggacttgggggactacagcccctggtttaccatacgttgaagaaacaataacaaatgctggaaattggttgattggaggcgacttggaggttatagctccgatcaagtacaacgacggtctcgatcggtttcggttgtctccggtggaactccgtaaagagtttgagaggcgcaatgccgatgccgtgtttgctttccagcttcggaatcctgttcataatggtcacgctttgttgatgaccgatactcggcggcttctcgagatgggttataagaatcccattcttttgcttcatccattgggaggttacactaaggcagatgatgttcctcttagttggcgaatgaaacagcacgagaaggtgcttgaggatggtgttcttgatcctgaaacaactgtagtatctatattcccatctccaatgcactatgctggtccaactgaagtgcagtggcatgctaaggctcggattaatgccggagccaatttttacattgtcggtagagatccggctggaatgggtcatccggttgagaagagagatttatatgatgctgatcatgggaagaaggtcttgagcatggctcctggacttgagcggctgaacatccttcctttcagggttgctgcatatgataatacccaaggtaaaatggcgttcttcgatccctcgagggctcaagacttcctcttcatatcaggcaccaagatgcggacattagcaaagaacaaagagaaccctcctgcaggatttatgtgccctggcggctgggaagtgttggtcgagtattatgccagcttaacaccatcggacaatgacagaataccgcaacccgttgctgcttagatgaattgaatttggaagcaaacctcgaaacactatttatctccatcgcgtaatctggaccttgtgaagtctcttgtgtccagatttttgttcaataaaaaccatgtggagaccctgtttcatagtcatgaaacttgcctccttgttactaggatgcccattaaggcatccaccattgattccattaagccatttaagcgtaagggcaaattgtactatatatataaatatattacgttancttttttagggggccccaaattttttttcggggggaattttgggaaaataaaaaggttttaaaggggcccatttcccccaaaggggggccaaaaaaaatttccgggggcccctttttaaaaccccgggggggga

SEQ ID NO: 436 - DNA, 1503 bp, Gossypium hirsutum
ataggcgggtcattatcgcatgtcaccattatttattgactgaactagacttgttttcagaagattacaatcatagagtgagttaacccaaacgcttcaaacaatcatgggttccttgcctcacactgctgcggaggctcagcagctagacctcgaggattccagtcgaaccgagagagtgcagtggctgattaattcacctgagcctcctagtttatggcaggaactagttggtacagtcaaaggaagtttgttaactcctggaaaaaagaattcctcatccaacgccaaggggaaacatgccatgtccttcctccgaggtctgtttccgatcctcagctggggaaggaattacaaggcttcattttttaaacatgatttaatggcgggtttaacactcgcaagtcttagcattcctcagagtattggatatgctaatttagcgaaacttgatcctcaatacggtctatacacaagcgtcgtcccacctcttatatatgcggtaatggggagttcaagagagatagctatcggaccggtagccgtggtttcaatgctgctatcttccatgattccaggcctggtggatcctgcaattgaccccattgggtacacaagtctagtgttcaccgtgacattctttgctggaactttccaagccatatttggattgtttagactggggttcctggtggattttctttcacatgctgcagtggttggattcatggcgggtgcagccattgtgatagggcttcagcaactgaagggactatttggactgagtcacttcaccactaaaaccgatgtagtgtcagttttgacctcggtttccaaatcagttaaacatgaatggtatcctctaaatttcgtcctcggtttatccttcctggtattcctccttgtcgccaggtttatcggaaaaagaaacaaaaagctcttctggttcccagcaatagctcctctattgtcagtcatattatccaccctgattgtatatttaaccagggctgacaatcatggggtgaagatagtaaaacacttaaaaggaggcctcaatccaagctcagtccatcgtttacaatttaatggcacacatgttgcagaagcagccaaaatcgggttgatttctgccattgttgctctcactgaagccatcgcagttggccgatcatttgcttcaattaatggataccatttagacggtaacaaggaaatgttggcaatggggttcatgaaccttgcaggatctctaacttcttgctacgtagccactggttcattttccaggactgcagtgaattttagcgcaggctgcaagactgtcgtgtcaaatatagtgatggcgattacagtgatattggcattggagttgtttaccaggctactgtattacacccctgtcgccatccttgcttccatcatcatgtctgcacttcctggacttattgacatcaatgaagcttaccgtatctggaaggttgacaaactagatttcctagc

SEQ ID NO: 437 - DNA, 1372 bp, Gossypium hirsutum
tcggatctcttttgaatgatgagtggaagaaacaggtttccttttactgcatctcagtatcaagagcttgaacatcaagctctaatcttcaagtacatggtctcaggcatccctataccacctgatctactcttcaccatcaagagaagctgcttggatacctcactttcttcaaggcttttctcttaccagcctcaacatattggatggaactgtttccagatgggattggggagaaaagtggacccagaacctggaaggtgtagaagaactgatggaaagaaatggaaatgctctaaagaagcctacccagattcaaagtactgtgaaagacacatgcatagaggcaaaaaccgttcaagaaagcctgtggaagttagtaatgcaacaatggcaaatccttcaacagcaactcaaaacatctcatcaatcaccaagacacaccaccccccttctttttcttctctttcttccatgtccttgtcttctgaatcccaacagcagcaccaacttcgctaccatggttatcattcccaggcgaatcacccctttatgtatccccatgcatcgagacctccaggggttggcctgtcacctcaagaaaacaccacacattctctcctcggctctggctcttactcccagactaacacggattacaggagaaacagttatgtttatgggttgaaagaagaagtagatgaacatgcttttttctctgaaccttccggtacaatgaggagtttctcaggttcatctgtggatgattcatggcaacttgcaccactaacaatgagctcctcttcctcaaagcagaggaactgttctggattacagagtgaatactcttacttgcagcttcaaagcctcactgatcacaacccgaaacaaaacaaacaggatgctgatgaacattcctatatcaaatatgaaatgactgatgaattggagaaaggagaaccccaaaagacagtccatcgtttctttgatgaatggccaccaaaacatagagattcatggcttgatttggatgataaatcatcaaacagctcatcagtttcaacaaccagactctctatatccatcccttccacttcacatgacttccccattttcaattcaagagctcataatgatggttgaatgtccagtggtaggtttctgcattagaggccaaagatgtacgtagtggggatcacttctttctgtgaattctgactgtttagtctttcatttatttcttccttctcctttggctttttgttttattgttttttgttttctgttctctttttgctaaatatggttaaattgggttgtgtttcttttttccccttattaatgaatgatccaatgacttcttactggtttt

SEQ ID NO: 438 - DNA, 1116 bp, Gossypium hirsutum
gaaaaaaaatctattcttactgctgcaactttcatagtgtgtgtaaatcttttaggccttttactactgctaatccagctgtatgttgccagtccatactgcatcttcttctctgcttttgaccctcatactgattatcaagaaatggaacctcaatacacacctctcaagattgcccgttttgcagacttcgggatggggcttacaaacatggagagtaatatgttgagtggtggagaagggtcgcctccaattgggctaggtcttgagcttggacgtggatctgatcatagaccaactgggttcacaaaatcgtgtggcttcactgtttttcaactgcaagaactgcagcttcaatctcttatctacaagtacatggaagctggtctccctgtccctaatcatctccttctccctctatggaaaagtgttgctggttctcttggtggtctccatgccaatccttatcaactctactctaactatttgggttctggaccattgcacttggagtataagaatggggttgatccagagccaggaagatgtagacgtacggatgggaagaaatggaggtgcagcaaagaagcagtcccagaccataaatactgtgagagacacatgcatagaggccgacagcgttcaggaaagcttgtggaagcttctcaagctaccagtagtggtagtcgtattatcaggcatggaaatgctgacaccaacctctccatttctctgcaacttgataacagtaatactagcagtagtggcagcagcagcaatctttcttccggctttattggtttctccccaaagagtgttcttcgtggaagtaacccaaaatctgaatcttcaatacaatttcaagaaatttagaagaaaagaaaaaaagaaaggtttaacaatgacagatctctatcgttcgtttgtaggttaagcgggttgcctggtggtgagtagtgatgatgatgggctccatttgtaatggaatttgtaagcttggaaacgtgacgatagttatgtttccacgggccccttttttttttttggtcatcggttgctctttttcacactgctgtggttaaatgacaatgaaatgctaaacttttatatggttcc

SEQ ID NO: 439 - DNA, 1400 bp, Gossypium hirsutum
agcagaaaaatgatgctctttcattcattccattaaaactgcaatgtctgatttttttttccagttacttgctagggtttgttttattttataccaaaaccctaaaccttacagtgtactgacactacacacattcatgctgaagcaaaatcatcaaagagtacaatactagtcagtagctagaacacttccaggccttttctccgatcggggttccaggaaatcccaaatatctgttcattcaaccatctgcagcgtaattcaaatgtgggtttcggaggatcaactatggagtttgaaactcaccgtgtggagaatgagaaccagttgtggagaagtcagatgatgccatcggaatggatatcgatagctgtgttgtagaaaatgaggtctggttggatctgtcatcttcaagagctgaccaggtgtccctggttttaggccactcgtcaaagaacggccgaagagattgaccctcgggcttcacagtttctcccgagttgaaatcgctgaaaaacgaatgctgagggtaatcattcagtaagaccgggttgccatcggattttgactgaggaaatgaagagactctagattgcattagaggccatgtgtcccggttgcttcccaaagcctcagagatgaaactatgcccacccgcgtcgggttttattccttgagacctataatctttcctcgggattccataggggattgactccacatgataattagactgaccggttgccaaagcagtgacttgcgtaccaccaaaggcatgtaatggaaggctctggaagcttgccgtcccagtcccaccaccactggtagtactaccagaaacagtcaatgatgtcacagtagataatgactgtgccatagtttgtgattccacaggctttcttgaacggttacggccacggtgcatatggcgctcgcaatactttgagtccggatacgcatctttggaacaccgccatttcttgccatcggtcctcctacatcgtcctggctccggatccaccttcttcccataaaaggaacaataccccatggtagggtggtgaaagaacctatgagatatggactcaaagctcttctgaatagggagcacaagatcaggtggcactggcaaacctgccatcatatacttaaagatcaaagcttgatgttccagctcctgccactgtgacactgtaaatggtgatgatgaacgacctcattgctaccatccccacaccggcactctcagcccccccaccacctccaccaccgccactattcatccttcaatcaccacccaagaaacttgtacttaataaattatacaacaacactggtacaaaagggcaaaagaaaacaataaaaaaagaaaagaaaagctcgatttgcccactattttt

SEQ ID NO: 440 - DNA, 1055 bp, Gossypium hirsutum
attttcttgagtgtagagttttggtagtttgatttttctttgttggccatatggattttggggtagtgggttttgaggggtttataggttcagagactgcaactggtttttcctctcttggttcagatcatcaagagacaagccaaaagtggtacggatctgggggtttgttcaagcaagagagatcttgcaacaatgaagatgagttgaggagttcaaaactggccaaaattcatgatgatttttcaggctcttctaagccattgatgttccaccacagaaatacttcattgagatccaatgcctctatcttctttgatgaacaagaagagcaacaaatgctgagcttctcagccccaaaaccagatgctctttcagtggatagaagctccaaaaatgtcacatttcctcacatttacctcacagggtacaacaacggaggatttaatggtgcaaacatgcatggagtgtgtaaaggtccattcactccatgtcaatggatggagcttgaacaccaggctttgatcttaaagtacatacttgcaaatgtgcctgtaccttctaatcttctcctccctataagaaaatcccttgattctaccgatttctcgagcttttctggtggacacttcagatccaatacatcgatgggatgggaagcttttcaatttgggttctcaaacaacactgatccagagccaggaaggtgtcgcagaactgatggaaagaaatggcggtgctcgagagatgctgttgctggccagaagtactgcgagcggcacatgaacagaggtcgccatcgttcaagaaagcctgtggaaggccaacctggccattccgtcacagccactgccgccactacttccaagctgatgcctaatgtctcatcctcttcagcatcagcggtagggccagttggtggtagtggtgagcccaacagcctcaccagtgctcggcagaagtacgagaatttgcagcttggtggcacatctaatctttctgctgcagcttcactgaacaggtcgattctgaataaagacactgtaggtgaaaaa

SEQ ID NO: 441 - DNA, 2034 bp, Gossypium hirsutum
aactccaccacactcaactatacatatcacctagtcatttaaagagaagagatttgcttggtggtctcctttgaagtgtgtggctacaagtttttttctttttctgctttgggttccactcactgtctgcatattcaaaagggatggaaaaaggggttttcctaaatggggaaagtggtttcaatatgggtattggctggagtttagcgtttcagacaaggtagctaaagaaagtagtagcattgaagcttttgattttgggtttgtgaagcttttcaaagtagtggtgttattgttatttagtacctaagaagatgatgatggccaactgtgataatcatcatcatcaccgttcatttccatcatatgtggttggttatggtgatgttgatgctgatgatggtcccacgggtaataacaacaacaggcctaagaccagtaatatatacgatgttttggctagcagtgattctagttctggttttgctgctactgttgctagtggcggtgcagttggtgtaaggatattacagcagccttttgacatttcccccacttcaacctccactgctattgtctcgtcctctgcctgatgggagatgttttgattttgtataacaacaggagggatggcggcttctttggagtttcctttcacgttttcacagtataaggagcttcagagacaagttatgatattcaagtacatgaaagcttccattgctgtgcctcttgatcttctcatacctactatcgggagcccctctgtttcagttgcttcccattctgccatggcaaggttttctggtagagcggatgttgagccagggaggtgtaggagaacagatgggaaaaaatggaggtgctctagagatgcggagcctgaccaaaagtattgtgagcggcacttgcatagaggtcgtccccgttcaagaaagcctgtggaacttcctaataagaagacccgccatacccttagtcaagcacatccttcatcttcctccaccactcgcccacagtttgttgctcagcccttaaaccagaaccagaccacctgttttcttggtcagccaagtgaaaaagctgcaccattttggcctttcacctctgtttcttcctacaaggaaaccaggacttcggactgggatatgaacgaacttattccactagctgatcagcagtggcatcatctcatgccaatagggactgctactgaaggttctttgttcaatgctggccatccaagttatgacaaggagcctctgaacttgatttcatgtccaaatatcgggtcttgcagaaaaccaacaacgcaatactagcccttggcttcttaaccctgagatagttccggtagaaaagtcgccacctagaggtttcattgatgcgtggtctactgctgtatcagatgaccaccttgccaacacaggaactgaaacctctgttaatgggaaactcactctttcatccctttctttatcaatgggaatcaatagcttcagggataatgagacaggacctatccgtatggggttgggggtgtgcgagtatgatcaggagaaccatgaatacgcttccaaatgccacctttctagctggttagcccctgcctctacaccaggaggcccattggccgaggttctaaggccgagtgccactgcctcgtctcccgtcgcgggaaatggaaattcttgtagttcagcgatgaccggagtgtcttcaccgtctggtgttttgcaaaaagctcttgcttcatggtctgatagcagcggtagtagcagcccgacgattgtttgttccagagccaaacctgagataggtttgatgttggcttaaacgaaattacaattccctcttttgttggaagttaactcaagattttactacagacggatataatatgttcttttttgtttctgtatggttttaagcacttagttgcaggttattatatacatatgtatcctgccttgttattacaaacttgttgattttgttgactaaaagaagagaatttgtcgtcgacgcggccgt

SEQ ID NO: 442 - DNA, 1269 bp, Gossypium hirsutum
gtggtggtggggggatgatggcaataaggacatcaccatttacagtgtcacaatggcaagaactggaacatcaagctttgatctttaagtatatgatggcaggtttgcctgtgccacctgatcttgtgctccctattcagaagagctttgagtccatttctcataggttctttcaccacccaaccatggggtattcttccttctatgggaagaaggtggatccggagccaggaagatgccggaggaccgacggcaagaaatggcgttgctccaaagatgcataccctgactccaagtactgtgagcggcatatgcatcgcggccgtaaccgttcaagaaagcctgtggaatcgcaaactatggcacagtcatcatctactgtgacatcattgactgtttctggaaacagtggtgggactggaagcttccagagccttccgttacatgccttcagtggttctcaacaagttactgcttctggaactaatcagtcccattatcatatggagtcaatcccctatggaatcccaagcaaagattataggtatcttcaaggagttaagcctgaggtcggtgagcatagtttcgtttcagaagcttcagggagcaaccggggtttccagatcgatactcaaccggaaaatgcatggcctgttatgcaatctagactctcctcgtttcctcagtcaaaacccagtggcaacccctccatgttgcagaatgattacccccagcatttgtttttgagcgaattcaactctggggaacctgtgaaacacgagggtcaatctcttcgacctttctttgacgagtggcctaaaaccagagactcttggtcagctctggaagacgagagatctaaccagacccctttctctactacccagctatcgatatccattccgatggcttcaccagacttctccacaaccagttctcgttctccccccgctagttgagtgacaaaaaatggggaaactctgaagatcagagggccgagccaagttgtagcttggtgcttaaacatgtgctgcttgaagattcttctttacctggccattgtgttatataactgtgggttttcagcgtcatttgtttgtactagagtattagaccattgcaaggttgaggttttaggttataaaataaaacaaaattcaagcaggtaaactgaaaaatccagaatattgcagccttaatccaattgaaagggcaagttttctttatgggttaattttactattatttccatcttaagaaactttcaat

SEQ ID NO: 443 - DNA, 921 bp, Gossypium hirsutum
gcaaaggcgatcatgtttaagttcaagctacttcttctgaaatatcattcacacttaagttctcgcagatctctgtaccacctttctttaatctgtgtttcttttttttcttcaatggatgcccaaccggttcaaactcgaattcttccagattctgggggtggtgggagtggggcccaagagaggttggaggggaagggaaggacggtgaagatggaagaggaggagacggagaggggaggatcaccgtcgatcaagttgggactggggattgatgggacgacgtcggagaaacccgtgaagaaacacgggaagtgtgtgtttacgacagctcagttgcatgacctgcaattacaaacgctcatcttcaaatacatagcgggtggaatccaagttcctgttaaccttgttatacccatttggaaaagcgtcgcttcctcctttggctctgctcatggcggtatctatgaacggtatcccagttttgtaggagtcagtcctcaaggattggattataggaacatggcggatcctgagccgggaaggtgtcgaagaactgatgggaaaaaatggcggtgcagtaagaatgtgattccttatcagaaatattgtgaacagcacatgcatagaggttgtcggcgttcaagaaagcctgtggaaacttctcaatccgctttgcctgactcaacatcatcaaaattttcaatcagattgtcagaaaactcaaaaaaccttccaacacctgtaagttttcagtacacgaacccattttcctgtaataccagcaccagccatggaaccactgctatagaaagcagctatgtatgcagcaaccgaaactccatttctatcaatgctgcaactagtggcaccatcattgccacaatgaagaacgacaacaaaaatgatccgaaaaggaac

SEQ ID NO: 444 - DNA, 1209 bp, Gossypium hirsutum
atatccatacaagcaccgaaaagttttaaaagcttttagctcagctagaatggctatcaatggtgatttcgtttccaaaacgaccctttttctggtcggtttaattgcattcatttcttttccagcagaagctgctgtaaggaagtaccagtttgatattcaagtgaagaatgttagcagactgtgccatgcaaagccaatcgtaacggtaaacgggaggtttccagggcctacaatctatgctagagagggagacagagttattgtcaatgttacaaaccatgcaaaatataacatgtccattcactggcatggattgaagcaatatcgaaatggttgggcggatggaccggcttacataacacaatgtccgattaagacagggaatagctacggttacgacttcaatgtaacagggcaaagaggaactttatggtggcatgcacacattctttggctaagggctacggtgtatggagccattgtcatcatgccgaaacaaggaatgccatatccgttcccgaagccgaacatggaacagcttgttgtattaggggaatggtggcacaaagatgttgaagagattgtcaagcaaggaaataacatggggattgccaccaaacatgtcggatgcacacactatcaatgggaaacctggacctctttttccatgttctgagaaacatacatttgcaatggaagtcgaatccgggaaaacatacttgctaagaatcatcaatgctgccctcaacgatgagcttttctttgcgattgccagtcataacatgacagtagtagaggtggacgcagtttatacaaaaccgttcgtcactcaagcgatactgattgcaccagggcaaaccacgaacgttctaatacaagccaaccaatcccctgggagatatttcatggctgctaggcctttcatggatgctccaatacctgtagacaacaaaaccgcgacagggatattccaatacaacggaatccccaacactgttcttcctacacttcctcagttaccagcttccaatgacacagatttcgctttgagttacaacaaaaagctcaagagcttaaactctgcaaattttcctgcaaatgttccccttaaggttgatcgaaaactgttctacacggttggtttcggcaaagattcttgcccgacatgcgttaatgggacaagaatcttagcctcgttgaacaata

SEQ ID NO: 445 - DNA, 843 bp, Gossypium hirsutum
caggcagaggacgagacaaggggtggtttgcaacacggaaaaagagctcgtcgttgagtgcagcattgactaaacgaagaagataggctttaccaggcttcactttaagcttgaacgtttctttagctgagcaattgtaagaagggcctgggaggccattaatggtgaatgcatccgagatattcggtgcccctccggttgccatggcctggtttataatcgtttcagtgtcggctttccaccattccccgaatacgatcggaaattctttgaaaggttgaggaaacggataagatgcatgtcgtttagggaggataacaataggtccatacaaagtagctctcagccaagagatatgtgcatgccaaaacaaggtccctctttggcctgtaatggtgaagttgtatacataggattgccctgtctgaatcggacactgtgtgacataagcaggtccatcggcccatccgctccgtaattgccggattccatgccaatgaatagtgacattgtattgaacatggttgaccactttgatgagaagccggtcgcctgccctcgcgattattcgaggacccgggaactgaccattgaccgtcacaatgctctttgtttgacacaaccttgtcacgttttgcattttaatattgaacttgtaatgcctggtaatgcccgcatgttttgcaagtgctaaatcaggtaataaccagacagaacataaagataggaacaataaagtcttggaaagggctgatgatgtaagaacagaaaccatatctacgtttttttaatctttttcagctgatagtcaaaagtgggatcaaaatactgatttggattttt

SEQ ID NO: 446 - DNA, 1258 bp, Gossypium hirsutum
  misc_feature (119)..(119): n is a, c, g, or t
atattaccctccttgttcttagcttttttcttattctaagtttacgattgaaacaaattagaaaaatggcagcttcacatatgctgttttgtttttgggttttattgctgtttatgaancaatgcagctggtgaaacaagacactacaagttcaatgttgagtacccacaatgttacgatactatgccacacgaggacggttctgaccgtgaaccggaagtttccggggcctcgattagtggccagggaaggtgatagagtgattgttaaggtggttaatcatattgcaaataatgtcaccattcactggcacggtgttcgacagttaacgacaggatggtcggacggaccgtcttacataacacaatgtcctatacagacaaaccagtcgtacatttataacttcacaattacaggacaaagaggaactctgtggtggcatgctcatatatcttggttgagagtatcgatttgtgggccgataattatactcccgaagcgtaatgaatcgtatccgtttgcgaaacccgacaaggaagtcaccattatgtttggagagtggttcaattcggaccctgaagctataatcggccaagcactacagacaggtgctggaccaaatgtttcggatgcatttactatcaatggctacccaggtccactctacaattgttcttccaaagacacttataagttgaaggtgaaaccgggaaagacgtatcttctccgattaatcaatgctgcacttaatgatgagcttttcttcagcattgccaatcacacggtaacggtggtcggaggtgatgcggtatataccaaacctttcgtgaccgacaagttagtcatcacacctggccaaaccacaaatgttctgctcaaaaccaaacctgaattccctaatgccaacttcttaatggctgctaggccttactttaccggacaaggcaccttcgataactcgactactgtcgggattctcgaatatgaacatccatcccctttgtctcgtcctctgcctgatgatctcaccataattcaaccagtactccctcccattaatgctacgggatttgtagcaaactttacagggaaatttcgtagcttaggcaatgctaaataccctgctaacgtaccgaaaaccgtcgacaagaaatttttctttacggtcggactcgggacgaacccttgtccgaaaaacacaacctgtcaaggacctatcaattcaagcaaattcgctgcttcggtaaacaatgtttca

SEQ ID NO: 447 - DNA, 707 bp, Gossypium hirsutum
ggaagtgggatgtaataaagaaaaactttgagaacatgaaatgtagaggacgtcaagaagttggggctatttatgcaatgttggttgatatttatggacaatatggaagattccaggatgcggaggacttcatatctgctctgaagtcagaaggcttcctaccatcagctagcatgttctgtgttctagcaaatgcttatgctcagcagggattttgtgaacagactgttaaggttcttcaactcatggaagcagaaggcattgaactcaatatcataatgctgaatgtgttgataaatgcctttggtatagcagggaggcctcaggagtccttatctatttaccaacatataaaagaaagtggtattagtcctgatgtggttacttatagtacactcatgaaagcttttattcgagccaagaagtttgataaggttcctgaaatatacaaggaaatggaatcttatggatgcactcctgatagaaaagctaggcaaatgctgcaaactgccttgatggtacttgaacggagacattgagtcttagactgatgttgctaatacctggtgacctgatattatcttcactttgctgtggcttttgctaagctgactaaatttgtaaagtgcatagatttgcttttaagaattgaagaccttgttaatatttcttctactggcattattgcatggattggatttgcaaaa

SEQ ID NO: 448 - DNA, 1282 bp, Gossypium hirsutum
  misc_feature (1039)..(1039): n is a, c, g, or t
  misc_feature (1041)..(1041): n is a, c, g, or t
  misc_feature (1073)..(1073): n is a, c, g, or t
  misc_feature (1086)..(1086): n is a, c, g, or t
caatggggacggagcgggctttcgagcggccgcccgggcaggtacttagaagaagttcttttccaccggctttttaaggaaggcggctcggaaactagcgtgcggcagcagcttaatcacttcatcaagagctccaagcgtgtctacaaatgggaagtagacgagactctcaagaagcttcgccaccgtaagctctatttccctgctctcaagctgtctgaaatgatggcgactaagaggggcatgaataagactgttagtgatcaggctatccatcttgatttggttgccaaagctcaagggattcctgctgctgaaaattacttcgttgatcttcctgaagcactgaaaaaccatctaacttatggtgcccttctcaactgttactctaaggaattgatgactgaaaaagctgaagctctgatggaaaagatgaaggaacttagccttcctttaagctctatgtcttataatagtctcatgactctttacacaaagattggccagcctgaaagggtacaagaaattatacaggaaatgaaatcatgtggtgtcataccagattcatatacgtacaacgtttggatgagggctctggctgctatgaatgatatttctggggttgaaagagttatcgaggaaatgaagagagatgctgaggatgctgatgattggacaacatatagcaatatagcatcaatttatgttgatgctggcttgtttgagaaggcagagaaggcacttaaggaattggaaaagagaaatgcccacagaaatctttctgctttccagtttctaattacattgtatggccgaattggaaatttgcatgaagtttatcgaatatggcgttcattgaggctctcttttcacaaaacagccaatataagctatctgaatatgattcaggtgttagtaaacttgaaagatttacccggagctgagaaatgctttagagaatgggaatcgggttgctctacttatgatatccggattgcaaatgtcttaattggagcttatgccaaggaaggcttgctananaaagctctaaaaactgaagagaaggcccgtanaaaaaggggcaancctaatggccaaacttgggaaattcttttgggattattatttgaaaattggagacaccagcctggctgttgattgtgttggccattgccatttcccctgggcagaagaagattggcgaaaatgtgggtccctcccccctgaagcctttggggaaggggtgaacctctccttttaaagccatttgaaagaaatgtgg

SEQ ID NO: 449 - DNA, 1333 bp, Gossypium hirsutum
gaaccgcaaaaggcaatttccatggctttaaccaaggcaaggcaacgctttccatcctctttctctcttccattcttcaaattttactcttcttcagtgtcaaccccactacaagaagttgaagccgccgatgttgaaacgactgtaaaaccccaacccgccgcactttcccccgaagaaacccaagtcgccgaacaattccgttccttaatcaaagagaaccaccgcaaaaaccccaacccagacccgaactcgacccctccatcccctaacttcaccatcccttctctctccctcgacttctccaatatctccaccgtccatcccgtctccccttccctcgtgcgctacgtcattgacaagtgcagtggggttcgccatggcatacctttcctccaaaccctgtccttcttcaattgggccgccgcacgtcccgactttgctcactctcccgacccttacaacgaaatgatcgaccatgctggaaagttgaggcattttggcttggcttggcatttgatcgatcagatgaaagccaaaagcgtcgacatctcactcgaaacattcgccatactaatacggcgttatgtgaaggccggattggctgcagaggccgtgcacgcgtttaatcgcatggaggattacgggtgcgttcccgataaggttgcgttttcagttttgattagtattttatgcagaaaaagaagggctgatgaagcccaaacttttttcgataaattgaaggacaaatttgaacctgatgtgattctctacaccagcttgctttacggctggtgtcgagcccgtaatatctcagaggccgaaagggtattcagagaaatgaaaatggcagggattaagcctaatgtgtatagttatacgattgtgattgatgcattgtgtagatgtggccaaattacgcgtgcttatgatgtttttgcggagatgggtgatgtaggttgtgagccaaattccattacttttaataacttgatgagggttcatgtcaaggctggtcgcacagagaaggtcttgcaggtttataatcagatgaaaagactcggttgcgctgcagatacggtaacttataattttctcatagagagtcattgtagggatgataatcttgatgaggctgttaaagtgcttaattcgatgcttaagaaagggtgtatcccgaattcgtctactttcaatactatatttaagtgtattgagaagttaagggatttgaatgccgctcaccgaatgtacgctaagatgaagagtataaatgcatgcctaatactgttacttataatgttttgatgcgaatgtttgccagcgccaagtc

SEQ ID NO: 450 - DNA, 1278 bp, Gossypium hirsutum
atcacacgttttttccccgccaaacgagcctcgtttttttcccttgctaacacagtatcccactcagctcaattctcttcctctggtgtctgagctaagccctctgctgccttcaagtttctggcaaatcaggaaattaaacaagggattttgtgaacagactgttaaggttcttcaactcatggaagcagaaggcattgaactcaatatcataatgctgaatgtgttgataaatgcctttggtatagcagggaggcatgaggaggcattatctatttaccaacatataaaagaaagtgtgagtctttatgtttcacatgatgttgagtggatttctaaattcattgtagacgctattaaccaattgtgcaggaccctttgtttcttccttcaattcatctttccagatactttttttccacctctcctaagtttgtcttccttttgaagggtattagtcctgatgtggttacttatagtacactcatgaaagcttttattcgagccaagaagtttgataaggtgctaagtgcagttgaaatctcttaagctttttgattagctacacatttgttaccaatgatagttgctaatgcttgcttgtcttttgctggctaggttcctgaaatatacaaggaaatggaatcttatggatgcactcctgatagaaaagctaggcaaatgctgcaaactgccttgatggtacttgaacggagacattgtaagtattagaccagtgtttggtatataattggttttaaaatttggcaataactaataacccagatttgtatcggatttgtctctttacattttgattgtttcaggagtcttagactgatgttgctaatacctggtgacctgatattatcttcactttgctgtggcttttgctaagctgactaaatttgtaaagtgcatagatttgcttctcagaattgaagaccttgttaatatttcttctactggcattattgcatggattggatttgcaaaatcacaaatgccatcctccctgctgccaccgccctgagataagcaacccacatcaacatccccttgaggtcaaacagccttcaaacttatgagttgagacattgggaggaaatttgataatcgtttgttagtgcttccttatcaatggtaaagtttctgtataaaacattgattttctttccttcgaagttaagaaatttgcctgtctttgactacagattcaaaactagccatttaaacacaattggttttattcacttagaaaaaaaaaaaaaaaaaaaa

SEQ ID NO: 451 - DNA, 1016 bp, Gossypium hirsutum
gctttcgagcggccgcccgggcaggtacgcggggatccttccgagcgcccccccgggctggtacatcccctgttaattttactctcaaaaatggctagctcaagtgtgggaatggtctgtcttttgctagtctcgtgcatggttgtgccgagcttggccaaagattacactgttggtgacacctctggttggacaactggtgtagattatagcacatggactaaagataagaccttcaaagttggcgatagccttgttttcaattacccaacaagccacacagtggatgaagtaagttcaagtgactacagtacatgcacggtgggaaacgcaatcacaacagataacagtggagcgaccaccgttgctctcaagaccgccgggacacattacttcatttgtggtgtggtgggtcactgtgcgaatggaatgaaactttcagtcaaagtggagtcaggttcatcggcagcaccatctaagtcgccgtctaagtcaccatcgtcttcttcgtcatcctcgccggcttccaccgataaaccatcgaccggcacaccatctactacaactacaacaactaaagccccagactcctcatcctcgtggagtctctccccatttatggctgttgtcacaacttgtcttgcgttgttggttttggtcatttcgtaataagctttcggcaaagagtgttggccagccatggtcaggatagaggcagtgctgctgatcttatctttttcccttttcttattcctttttattatattgtttgtgctgaggatcattgtatgttcatgaatgagatggttgggcttccatggcgttaggcacgtacatcatatatgtaagttatattgttcattgttgtatcatgttctatgtgaacattgattgggattttcaataatccatcgccttttggctacaccggaaattagagctaaagtatatatgactaacaaggtctataaatattcaattataatatataatttatgtcatttcttgtcatactc

SEQ ID NO: 452 - DNA, 619 bp, Gossypium hirsutum
acctcgctcactccaacagccttttccacttctaaaacctttagcttttctcagagatggcgcagggaaggggcagtgcaagtcaagcgaccatgtccgcaattgcattgctattgtgcttaatggtttgcctggaaaccattgatgcagctacttacactgtcggtggctctaatggttggacttttaacacggctacttggccaaaagggaagcggttcagggccggcgacgtgctaggtaactccaaataactaaacaaaatgatgaaaatatttcctagtctgtgtctgaagtaaaaattctgtgatgttgcagtgttcaactacgatgcgactatccacaatgtagtagcagtgaacagacgagggtacactaattgtaccacacctgcaggtgcaaaagtgtacaactcaggaaaagataagataaaactggccaagggactcaacttctttatgtgcagcactgctggtcactgtgagtctggaatgaagattgcaataaatgcagtgtgacacagattattgccttctcttctaaataataggttgaatgtgctactacattgtcgtctttggttttaagttttaactaaggagaatgttattccaacttt

SEQ ID NO: 453 - DNA, 609 bp, Gossypium hirsutum
acctcgctcactccaacagccttttccacttctaaaacctttagcttttctcagagatggcgcagggaaggggcagtgcaagtcaagcgaccatgtccgcaattgcattgctattgtgcttaatggtttgcctggaaaccattgatgcagctacttacactgtcggtggctctaatggttggacttttaacacggctacttggccaaaagggaagcggttcagggccggcgacgtgctagtgttcaactacgatgcgactatccacaatgtagtagcagtgaacagacgagggtacactaattgtaccacacctgcaggtgcaaaagtgtacaactcagggaaagataagataaaactggccaagggactcaacttctttatgtgcagcactgctggtcactgtgagtctggaatgaagattgcaataaatgcagtgtgacacagattattgccttctcttctaaataataggttgaatgtgctactacattgtcgtctttggttttaagttttaactaaggagaatgttattccaacttttttatttttattttaaatatttatgtttaacatccgtgttctacttatattggaataaaagtaaatag

SEQ ID NO: 454 - DNA, 1061 bp, Gossypium hirsutum
  misc_feature (216)..(216): n is a, c, g, or t
caacgggattaaaatgggtaacccccgggtttttcccgttcccccttattaaatccagggcccgaaaaagaatttatgtgtgcccaaaaaaaaattttaagctttgaaaaggggggaaaaaaaattttgttcttttaaaggggccccccccttttttttttttttttttttttttttttatttaatatttttttttgttttttttttaaggaaagnccatcattttatatctttgtttttttttttttttttttttttttttttttttcgcggcctgattataacgctatataggcaattggctttcgaccggccccccgggcaggtactttttaccatagaaaacagaacaagtaaggttctcattcataaaataaaagcaataatcctcaatacaaacaaagcactgcctctatcctggccaagccaaccaccattttagccaccaaaagcttatgaaacaaccatcatcacgcacaatgcgacccaagttgtagcaaaagccagaaccggtgaaagactccatgaagaagatgaatccgggatcttagtcgtcgtagtagtagatggtgaagtggttgatggtttatcagtggaagatgaagaagaagaagactccactttgaccgcaagcttcatgccgctctcacaatgaccagccacaccacaaatgaagtagtgagtaccggcggtcttcagattgatggtggtggctccggtgctatccgtcgagattgctttccccaccgtacatgtactgtaatcgctagaacttacctcctccactgtatggcttgttgggtaattgaaaacgagggaatccccaactttgaaggtcttgtcgttagcccaaccactataatcgacaccggttgcccagccagaggtgtcaccaacagtgtaaaccgtggccaagcttggcccaaccaccatgcataaaactagcccaagacaggccattcccacacttgagcttgccattttcttgtggaagaggctaggtggagaaacactttgaaaacagagataggagaattttgtcgcgtgggcggacgcgtggg

SEQ ID NO: 455 - DNA, 1011 bp, Gossypium hirsutum
ccctcgcttccgctttttctttctcaataatatcacactaccatttcattaaaggttcttttttttcccttgaagtttttatttttttttgctaaattgaaaccgatttttatggcactgactcgatcgaaacaattggtcctactcaagtcaccctaaaccaacaaccccattatatggggccaactccctagtctagctactcctcacaagctcacccagtgcaccccactcttattttctccaagttgtagagaaataggaatggttcagggaagatgcagtgcagtggcagccacagtgctgctctgctgcttgttgctccactttgaggtggctcaatcagcaagtttcactgttggaggaagaggtgggtggacctttaacgccgctgcttggccaaaaggcaagccctttaaggcgggtgacactctcgtgttcaattacaacccttcaatccacaatgtggtagctgtgaacagagcaggatacaaatcatgcaaagcaccaaaaggtgctaaagttttcaagtcaggcaaggatcagatcaagcttaaaaagggccaaaactttttcatctgcaattacattggccattgccaagcaggaatgaaaatagcagtcactgctgcctaatccgagattaggcattgccatatgatatcttcagtttgctttaaagtattaatgtaagatttggtgtcacaaagtctactctagtgttggatttgcttgctttgagtgggtaggtggtgctccaaacactaaatctatactataataatgatggttttaagtggaaatcttttgtgtaatgctttgtggctaaggttttacttgtactcccttttgcaataaaatatataaagatgcttctaccagttttattaaaagggcccccaaaattcaattcaggggcaaattctgcaaatttccttcacatggggggccgctcaaaaatgcatctaaagggcccaattccccctatagggagccgaattacaattcccg

SEQ ID NO: 456 - DNA, 563 bp, Gossypium hirsutum
  misc_feature (522)..(522): n is a, c, g, or t
cccacgcgtccgcccacgcgtccgggaggtagcaagcttgaggcaacaactaaatgacttgcaagaataccacaggcagctgatgggggaagaactatctggtttaagcatcaaagatctacggaatctagaaaaccaacttgaaatgagcttgaaaagtgttcgcatgagaaagggacaccacattcataaagagaatctagaactacagaagaagctagaccttatttgccaagaaaatactgaacttcaaaggaaggttgatggaaatggaacagtagaagcaaatgaaggcagcaaaagctcatcccacagttatggtttcaacaatggatatgatgagttgcaggcacctgttgtcgatctccggttaagcctgcctcaacaacttcccgacgctgatacatcgtatagaaacctaagactgttttgaaaaccagtccctctacaatttggaaagcgtattttcaatcttgaggtcaaatcttttgtgaactccgtcagataatttaaatatgcttntaaaatatatatatatatatgtgatagatgtaacatataca

SEQ ID NO: 457 - DNA, 1757 bp, Gossypium hirsutum
gcgttcgcccagcgtccgcggccgcgtgggggggggcttgcctctttcaacttggtctttcctccagctttccttcttcctaaaattattaatcattttcatgggtgttttgcgtttttgttccttcactggcaaacacaagtatcaggtatccagatatcatttcaagaaacaagcctatgtggggtgtgtgctatccaaaatcagtgtctcatttccttgagatgggttcagcaataaaacatttcgtggagttagttgaacaagcaggaactgtttttgaagttgcaaacactatacggggtttagttgaaaaccattgggaattccctaaaggcattgatcagaatgtaaataatctgaagagaaaaagagatgaactaaatggtcagaaagaagacgttgaatcaagaataaaatcagagctgcgtccgagaaagaaggtcaagaaagaagttgatctgtggattgaaaatgtaaaaaggataaatggggaaattcctaatctcgaatccaaagttagaggtagcagctttttccctcgtggatttcttgttaagaatgttcgtaagaaggaagaagaagttgaagaattgcttgaaaagggtagattttctgatgatttggttgtcaacgatctttcgtggattggtcaggtgttgccaacaccgagcttagtcgttgaaacagtaaaacgtaaaaagaatgagattatgcaacacttcaggaatgatgaggttcaaaagattggagtttatggaatgccaggagttgggaaaacaagtgccgtcacgcttgtcaacaatgaactcttaaaaggtgaaatcgagttcaagatcatagtatgggtcactgtagggaggaaatgtagtgttattgaactgcagaataagattgcaaaggcaatgaatgtcagtatttccgaagatgaagacgagactttaagagcagggatgttgtctgaaattttgagtgaaaagggtagatttgttttaatattggatgatgtatgggagagattttccttcgaaaaagttggaattcctgagtcttctaagggtaaattagtgttgacatctcgttcattggatgtatgtcgacgaatggattgtcaagtcgtaaaaatggagccactttcgaatgaagatgcatggacattgttctcggacaaggttggtcaaaacctaatgagttctatagatttacaaccgattgcaaaatctatcgttgagcgttgtgccggtttaccgttggtgatagttatagttgccagtagcatgagaagtgaagatagttttccaatatggaggaatgcgcttgcagaattgaaccgaaacatatcgagtatcatcgaaattaaagacaaggtgtatcaacaactgtgattcagctacgatcgattgaaagatcaaagaatccaaaattgtttccttacttgtgcatcgtatcgtgaagactcgggaattctaaaggaacaattgataagggattgggttggaaagggattaatagaggaaatgggtagcttggaagcaaacatggacaagggacaagcaatactaagaacattagtagagaattgctagttagaaaatgtaggaaatgaaagagtaagaatgcatgatcttgtaatagatatggttaaacttatcactcaagatttgtatgaatcataaattaacattgcacatgtatggttgggtctcttacactttttattttagatgaattaaaatggtacactaaattcactattc

SEQ ID NO: 458 - DNA, 736 bp, Gossypium hirsutum
atcaggcagaggacgagacaacaaattccttagagaccaagacccatattaccacatcaaaattgtgatcgctggaaagaaatgcattattgatggtctttagaagggtagttttcccaactccacccactccatataatgcaataattcccactttttcctcctcaagaaactcccacaccttgtctaacatcacaccaatgccaattgcaggcttacacggtttctcttctacaggagcaggacgtggctcagtcaccagtctctcaaagtttccttttcccttcagttcacttatatcctgcagcttctctatcatttccgtgctcatattgtatttcgaacaacaacttggattgaagcaccccaacccttgcctactctgtcggaaattctccataatggaggcagcttcagcttcgataacttctactcttgccagccacctctgcacttcatttgttcgtcttgatccatccagctcagctcgctcgagacgagtcgtcaagtcatctctcttgtccatcagttcatttagttctgcagtcaagtagtgcatgcttctgtccaaattgataacacggcatgcccgagaggccgttgctgtgcataatctgtcaattatactgatcagaggggtaatgaaatccatagataaaaagctaaacgtgcttggtatagaagagcagagacttaaggtttatcataaaatggttaatagattctttctgtactt

SEQ ID NO: 459 - DNA, 455 bp, Gossypium hirsutum
gcacgagtgacgacctacaacagtttgatgtatatgtatagccgctctgaaaagttcgaggaatcagaacaaattttaagggaagttcaggcaaaaggaataaaaccagatataatctcgtataacactgttatttatgcctattgtagaaacggtcgaatgaaagaggcttctcggatattttcagaaatgggtgattctggccttgttccagatgttatcacttacaatacctttgttgcaagctatgcagctgattccttgtttgaggaagccgtagatgttgtccaattcatgatcaagcacggctgtaaaccaaaccagaatacatacaattccatagttgatggatattgtaaactcaatcagcgtgatgaggcaaagacatttattgacaaccttcagaagctagatccacatatttccaaggatgaggaaattagattatcagagcg

SEQ ID NO: 460 - DNA, 390 bp, Gossypium hirsutum
agacctgatacgcttttttacaactgcttgatccatgcgctggggcgagcaggccaagttgaagatgctattaaggtttttgaggtagagatgccgaagacaggtgtttcccccaatacatcgacgtataattgcatgattgccatgctttgtcatcatgctcaacaacagaaggccctatctcttcttcaggacatggggaatttgaaaatttgcaagcctgaagttcagacatattaccccttgctgaagtcatgctttaaaactgggaagatagataacctgttgagcaaactattgaatgatatggttaataagcatcatctaagtcttgatagttctgcctactcactattgattcatggactttgtagagcaagtagaagtgag

SEQ ID NO: 461 - DNA, 600 bp, Gossypium hirsutum
  misc_feature (539)..(539): n is a, c, g, or t
  misc_feature (588)..(588): n is a, c, g, or t
ctcccaagtcccaaccctttccctgaacaccacgtcgcaacccaaaatttacacttcttctgctactgccgctgccatttctgctttcaagatatgcttaggtgttgagcctgatgttgtcacgtataatacgtttgttgatgcgcattgcaaggaagggatggtctctgaagctgaggatattgttgacgcaatgataaagcgaggcattgagcctgatgttgttacctatagtgcattaatcaacggccattgcttgcagaatgaaatggataaagctagaagagttttcaacttgatgattgagaagggttgtgcacctgatatagttacttacagcaccatgatcaatggatattgcaaaggggaaaggttagacaaagcaatggaactctttcatgaaatatctcgaaagggaccattcccggatactgtctcatacaacattcttatgcagagtatgtgtcagttaggggaagtttcaactgcatgtaaactttttaaaaagaggcttgcctctggacaaattccaaatatancgacctgtttgattttgctggatggtttatgcaaaacaggtcatatcanaaaagcattgat

SEQ ID NO: 462 - DNA, 717 bp, Gossypium hirsutum
ggaaaatgtcttcccgaattggaagccgtaagatattttcccttctcttcttccttcctctctgtccatcgtcccttctctttgttggcctcactgtcatcagcagccacagtcgagaaaagaagacccagaaggttcccttctattcgttgaagattcttgaagtgcttgtactgaaattgttcgtattgaactgcgattgtaagtgttagctaagtggcctaataaatcaagggggaaaatgaaaaagaaggttctaaatctttgattcaaatctgggttcttcatgttgtttggtggttttctagaactgggttctcttcactgggggcttgctgcggacgcgtgggtgataactgtaaaccagataggtttacatacaatattctcattcatggtgtttgtaaagccggtgtcatcgatgaggcagttcggttagttaagcagatggaaattttcggatactcaccgaatatgtgtacttataccatcttaattgatgggtactgtaatgccaggagggtcgatgatgcgtttaaacttattgagacgatgaagaaaaggaatgtgtttcctaatgaagctaccgtgagatcgttgattcatggggttttccgttgtgtggctccacgaaaggcattcgagttgttgataatgttcttggagaaggagcctatgatgcagagattggcttgtgatactctactgctttgtctt

SEQ ID NO: 463 - DNA, 713 bp, Gossypium hirsutum
  misc_feature (634)..(634): n is a, c, g, or t
attgtgtaagagcgccaaggttgtagaagctgaaatatttttgcataaaatggtgaatgaaggtttggagccagatggttttacctacaatgctgtcattgatggatattgcaaattgggcataatacaagacgcagataagattctcaacgatgcagttttcaagggttttattcccgatgaattcacctattgttccttaattaacggtttatgccagcatggtgagacagaccgtgctgtggctgtatttaatgaggctttggggaaaggattaaaacctaatattattatgtataacactcttatcaaagggttgtctttgcaggggctgattttgcaagccttgcagctgatgaatgagatgtcggaaaatggctgcagtcccaacatatggacttacaatatagttataaatggattatgcaagatggggtgtgtctctgatgctaacaatttactgaatgatgctattgcgaaaggttaccttccggatatctttacatttaatactttgatcgatggatactgtaagcagttgaaagtggaaaatgcagttgagattttaatcaaatgtggaactatgatgttttcctgatgtgatcacatataatttgtgctgaatggctttgtnaaattttacgtcgaaatgtcttgaacttttaacctgtgggaagggtcttccatgtatcttcatttctttgaacctgtga

SEQ ID NO: 464 - DNA, 940 bp, Gossypium hirsutum
cccacgcgtccgcggacgcgtgggttatagatgggtattgcagaaatcgtgcgatgtcggaagctttgaagatcagggatgaaatgctagaaaagggatgtaatatggatgttgttacttacaataccattttgaatgggttgtgcaaggagaagatgctcactgaagcagacaatctattgcatgagatgacagaaaggggtgtttttcctgatttttatactttcacaacactcatccatggacattgtagggatggaaatatgaataaagctctaaacttgtttgatgcaatgactcaaaggaatattaagccggacattgtgacatacaacaccttaattgacgggttttgcaaggtaggtgaaattgagaaggccaagcagctctgggctggtatgatttctagaaagattattcctaatcacatttcttatggaactttgataaacggggtttgcagcattggtcatgttccggaggcattcaggttgtgggatgaaatggtagggaagggtattaagcccactcttgtgatttgtaatagcatcataaagggctattgtcgatcaggtgatacgtcaagagctgataagtttctatccaagatgactgcagaaggaattgttccagatagcattacatataacacttttatcaatggatttgtcaaagaagagaatatggacaaagcttttctctggattaacaagatggagaatcaagggctttctcctgatgctattacatacaatgtaattctaagtgggttttgtagagagggtagaatgcaagaagctgaaatggtattaaggaagatgattgagaaaggcatagatcctgataggtctacatacacatcactcataaatggacatgttacccaggacaacttaaaggaggcatttcggctacatgatgacatggtacgaatgggatc

SEQ ID NO: 465 - DNA, 742 bp, Gossypium hirsutum
attggataaataataattgctggctgagaatttccaatttttcgttccacctttcgtcaattatctcaaaggaaaagtaaatcactgaaaaacccatttttttcttttaaaaagcatatctttctctacaaatctattttccttcaattacccaaactcagattccaattcaaagagttccataaataaaaaaagttccttttttttgtacttctcttgcttttcattggttcttcttcttcttcttcttcttcttcttcgtattttatttaataatttttgttcgttgatggtcatctaaattcatttcgaactatataagacgagagtaacttgtacttgtttcatcagttaaaagatggttgcctttgggaagaagttgaaggaaagacaaattcaagaatggcaaggattttacctaaactacaaattaatgaagaagcgagtcaaacagtatgctcaacaaatggaagttgggacacaagatcgccgacatgttctcaaggatttctcgagaatgttggataatcagattgagaagactgtcctttttatattggagcaacaaggccaacttgcaagcaggttaacaaatcttagagaacaacatgatgcactcgaggagatgccggaaatatcccaaataacagaacttagagaggcttatagagcagtcggacaagatctgttgaagcttctctgttttgttgaaatgaacgctattggtttgcgaaagatattg

SEQ ID NO: 466 - DNA, 1343 bp, Gossypium hirsutum
aactttggagtcgaatattgttctgaataatgcaagacatccacttgatcggaggtggccgagtattcagcggcggcggtggaggtggcggaggagatagaaggttaggactgcaacaccaacaacaaaacaaccaggcactcaagtgcccacgttgcgactcacttaacacgaagttctgttactacaacaactacgatctctctcagccacgtcatttctgcaagagctgccgtcgttactggaccaaaggtggtgtccttcgtaacgtccccgttggtggtggttgccgcaaagccaagcgttcgaaaaccaagccttcatccgaatccacgacagtcgccgccgcggcccttgcacagccacaatcacagcaacaccttgatcaacgtaaagcgaattctcattctagcagcgacagttcgagtcttattgcagctaattctaaggttgcagtgacaaataaaaacaacaacaacgatagttctacaggcggcatggcggaggcggtgtcggcagtaacgtctcattcaaacaatataaatgtaagcgagtcgaagttgtatggaaaccccaacaatttagtcttcgaggcaggattactggaacaaagatcagaatcggggatttttccggagattgggagttttacgagcttggttacttcgtcaaacaatgaaacgtcgtcgtttggcttcggtacggtattaaatgggcaaggacagtggcggcagcaaaagatgatgagtgttggaggggaggaaatcaccggggaattgctcgatcagacgatgcaggttgagctttcaaatttgcatggtagatcggagagtggatttggaccgttggattggcaagggtgtggagatcaaccgttctttgatcttcctaatgatgttgaccaatcgtattggagtcaaagtcaatggtctgatcaagatcatacggccctctatctaccgtaaattgtctcactctcaccccccctccttaaattatttattaactatggttcaaagcttgaagtaaagaaactgaaagagagttaaattgatatataaatccgactgtttcttgtgtaaaacgtttaaaatttttcttaatttttttacttaatatttaagttctattttggtgatttttgaagatgtttccagttttttttaatgcaactatattttggggagcaggattttgttgatggtgtatctgaattcaattaatgtagagaaaaatatagatttcaggttttaatttatgattgatatttgtagttttgagtgtggcacatgtagtggttttacttaaatattcatctatatttaattatgatgttaggagat

SEQ ID NO: 467 - DNA, 812 bp, Gossypium hirsutum
aaactaatccatatactgcaaaatccttgtgcatcttcttcaaagcaaacagcaacaactccaacaaatgtccatgaaaaaagaaggtgaaattctatacaaaaagggattatgggcaatggaggaagacaagttactcattgattatgtcaatgtccatggaaaaggacaatggaacaaaatagccaacagaacaggtttgaagagaagtgggaaaagttgtcggctaaggtggatgaattacctgagtcctaacgttaaaaagggtgatttttctgaagaagaagaagacctcgtcattagacttcataagcttcttggaaacaggtggtctttgattgcgaaacgagttccaggtcgaactgacaatcaagtcaagaattactggaatagtcatttgaggaagaaactagggatcattgatcaaaacaagacaaggatcgatttttgtcaaagttcaaagcaagtcaaagtgtgtcatgttgatgaggcagccacggatccaagtcctggacatggaacaaccactgaaaccacgggtataacagtggatcagagtaaccagcaggaagtcattgatcatcgggtcttaaacaatactactcaagaatcaatgaccagtgagagttatatcaacactttctggattcctgaccatgattatgagctaagtacacttgccatgattgaccacttccatgaatgggtcttcttttcatcttagctagagactatgttattaaaattacgggtttaatttttaaatataaagtatgccttctaacatggcatagttgaaatttttaaaagat

SEQ ID NO: 468 - DNA, 913 bp, Gossypium hirsutum
cccttccgcgcgtccgcccacgcgtccgctggtaggttgagatggaagaaaagagtgaatataaaaaagggctgtggagtgcagaggaggacagcatcctgatggagtacgtaaggaagcatgggaaagggaaatggaatcggatacccaaagtaacaggcctcaagaggtgtgggaaaagctgcagattgaggtggatcaattaccttagtcccggtgttaagcgtggtcgtttctccgaccaggagaatgatcttatcatccgccttcataacctactcggcaacaggtggtcactcatagctggtcgggttccaggaagaacagacaatcaagtgaagaatcattggaacactcatttgagcaaaaagcttgggatcatcaaaaatcctactgctcattcttcacaatcccaaactcactccaagtctagtagagatgatgataatagccatagccaagcgcaagaccaggtgatgatgaccaccacagatgccttgccctcgcctcgtgactacggaaacggaagctcttcttggttttggtagtgtcataacaatgatcatttcaatttgtatacacctacccctgtcaatgtcttggacttactagaccacgacgaccacgtctctcttgattttgtttggcatggctttgcctaaccttgtaatctctgcactcctttttgtcacctcaattattgttttctactttggattgtattgcaacatttattatttttttactactttccctgttttccttctttcttttgtgttatattacatggattgggattgcattgttataattaataattgattatcccttattcctcccgtttccctctattctagtctaatttattcataaaagtaaataaaagtttagtccaaattaagattatgctttt

SEQ ID NO: 469 - DNA, 888 bp, Gossypium hirsutum
ctccttcgctacatctactctggtctgtggcttttgcatgcctcaattcattgcctttgggtttgcaaatgaggaagccttgttgtgaaaagaaagacacaaacaaaggagcttggtctaaattagaagaccagaagctcacggattacattctaaaacatggtgaaggttgctggcgctctcttcctcaggctgccgggctgcttcgttgtggaaaaagttgtcgactgagatgggtaaactacctgcggcctgaccttaaacgaggcaattttggtgaagatgaagaggaccttattatcaaactccatgctctccttggaaataggtggtcactaatagcaggaagattgccaggtaggaccgacaacgaagtgaagaatcactggaatattcacttaagaaagaaacttttgatgatgggaattgacccaaacaatcgtcgttcgcttctatctcctacattaaccaaatccaatgcatccaacgactccagttctgcatgccaaccctttaatccagcaactgcttcggagactatcagcagtacttgtttacccgacctcaatctggatcttaccatcgcccctcccctttcccatcaaaacttggcacttaattaattttaagtctataatgtgatatttccatcactattttactgtttaattaatttcatttttttatcacaataacacctactatgcttataagccggttaaaatatgtttgcgagttagagctcaaaaatcctggctggagtctacttaagtgggatacactgcatgtctagccacgaatttagactatatctctaaaatcgtgtcctatcaagaatatacttttcatttcttttcctgctgaaactaccacttgcagttgattatg

SEQ ID NO: 470 - DNA, 380 bp, Gossypium hirsutum
taaagttggaacactattgcaagcaaagcaggtaactaatccaagtaattgaatagatttctttttcctttgttttaaccttgtttttgcaggtttgaagaggtgtggtaaaagttgcaggctgagatggatgaattatctgaggcctaatattaagagaggaaatatatcagagcaagaagaggacttgatccttaggcttcacaagctccttggaaacaggtggtctttgattgcgggaagattaccaggaagaacagataacgagatcaagaactactggaattctcatttgagcaaaaaaataaagcagaaagagaaacaaggctgcaaagatgaaaagagatcagtggagaatggcaaagaggaattgagacaag

SEQ ID NO: 471 - DNA, 882 bp, Gossypium hirsutum
tgaaaaaatctgggccactaaagaatggagcaaaatttgtcccttaagagattcgacgtcaacaagggagcatggacagctgaagaagatagaaaattggctgaggttattacagttcatggtgctaaaaggtggaagacaattccatccatagcaggtttaaataggtgtggtaaaagttgcaggctgagatggatgaattatcttaggcctaacatcaagagaggaaatatatcagaccaagaagaggacttgatacttaggcttcataaactccttgggaacaggtggtctttgattgcaggaaggttaccaggaagaacagataatgagatcaagaactactggaattctcatttgagcaagaaagtgaaccagaaggagaaacacagaggagcatcagctaggcaaggctgcaaatttgctcaacagagattggtggagaatgccaaagaacaagtgagagaagagaatacatctactggatttggggagtccaatataagcttcgatgtggatgacttctttgatttctccaatgtggatacccggaactttgagtgggtgaacaggtttcttgaagttgacgacggttttaagttttaactgaagctttatggatggaaccccaagagctttctgttgtttgtttatcttctatcatcatgattcatgaatttgatgcaatccatgttaatatgtaaaaccttgttatcttccctgaatttggctacatacgttttttgtgtcggctatatgccctagttgccgacatagtgaaacggtagcacagactcttgttattggtgtcaatcaattagaccaacaagttgaaccccaaaaaaaaaatggctaatataggaaagagacttctggaaaaat

SEQ ID NO: 472 - DNA, 1392 bp, Gossypium hirsutum
ctctttcagcacgttttatctttcctcatttcggttcctatcctataaaaacctaaacttttgataccttccatttcccagcaaaataaccaatccaaaaagaatcccccaaagcaaaaactcaggaaaaaggatcatatatagttgaagaaatcatgaagaacccaagtttagtcggtaattcaacaagcagcaagggtactccttgttgcagcaaagttgggataaagagaggaccatggacgcccgaagaagatgaagtgttagccaactacatcaaaagggaaggcgaaggacgatggcggactttgcctaaacgagctggtttgcttcgatgcggtaagagttgtcgtctccggtggatgaattatctccgaccctctgttaaacgaggtcgtattgctcccgatgaagaagatctcattcttcgccttcatcgcctgctcggtaacaggtggtcactgatagctggtaggattccagggcgtacagataatgaaataaagaactactggaatacccatctaagcaagaagctgatcagccaaggaatagatccaagaacccataaaccattgaaccttattacccataaatcgccacagattaatcatgatcatgttccaaaatcaaaccctagcccccctatccctaatccttctgtattagcatcaaaaaccattacaattaaaactacaaacactaccaaagatggtacaccgactaacctggaacatgggtatcagcagcaatctcaaaaccaacaggttgataagagcatggagaaatggaagaatactgaaagtgcaactcttatcatggcggaaccaagcagccatggaaacgaaggggatcatatggaaaattgcaatgaagatatgttctcctcgtttctagattcattgattaatgaaaacttgcttgttaatcaacacccagaagagcagcaacctaataatttggtggcaccggcggcagcagccgcagaatcttctcagaacttgtgtcatggcgacatgtgggaaaccgaactcatatctgcaatggttggttttgggaatgagccaaactctttcaacaatcattatcattatctgcatcaactttagcagatcaaactgcaaatttatatgcatattgaaattagatgttttttgattttctacgtttgtttctatttattttccctttttctttctttcattgctcggttgtgttattgttttgtactcattttatttgtatgcttgcccctacaatgaaagtttgtagttttattcgtagtgtctattaaaatgtatcaatccctaaatctgtaatttcctacagaaattaatgaaattattgaagcagaaggttgagtattacttccaaaaaaaaaaaaaaaaaaaa

SEQ ID NO: 473 - DNA, 916 bp, Gossypium hirsutum
atattcataatcatgaaacttattttcgaggtttttcttttgattcccttttagggtttcttgcaagttaattccaatgattcatctttggctttttttgaaggtactagcaatatcacacacacacatatatatatgcatatgaatatatgaactgtaagatcaagggttcttacactctgaatattttcaggtgggcattgatagctgggaggattccgggacgaacagataatgaaataaagaactactggaatacccatctaagcaagaatttaatcagccaaggaatagatccaagaacccataaaccattgaaccctgttagccatagttcatcacaagctaaccaggatgatgatgatgatgtcccagaatcaaaccctaatcccccaagctcctccaaatcttctgaattaatgggagaaaaaactaattccatggaaactactaacctggaatctcatcagatatatcaacaccaacaagaggttggtgacgattgcatggggcagccaagcagcagcgggaacgggggagacttggttgaaaatggtaacgaagaccatatgttctgtttgtttctggattctttgattaccgacaatcagcagcagcagcagcaatctaataatggcgacctttgggaagctgaaatcatgtctccaatggtggagtttgggaacccccaaaactacttcaatcatcaccagcagcatccttagcaaagctgccaaagtagtagatgcattttggttttacatttcatattataaattgaaaatggattagaaagtatcggtttcatttgtatgcttgggtggttgttgttgtatgtagttttcgtctctttggttgtgttaattgttcagcgaagaactgatttgtttaagaaaaaaaaaaaaaaaaagggcgg

SEQ ID NO: 474 - DNA, 975 bp, Gossypium hirsutum
tctcactctttgcctcttctgactgttggctaataatggctccaaagaaggctggagtgagcaaaagggtttttaacaaaggttcatggacagctgaggaagatagaagattggctaaatatattgagattcatggtgcaaagagatggaaaacaatcgccattaaatcaggtttgaatcgatgcggcaagagttgcaggttgagatggttgaactacttgagacctaacattaagagaggcaacatatcagatgaagaagaggacttaattattaggcttcataaactgctgggaaacaggtggtctttgattgctgggagacttccagggcgaacagacaatgaaattaagaactactggaattcccatttgagcaagaaaatgataaaccatgatgtcagaacagaacaaacttcctcctcggaacaaattgtgcctcacaaagcatgggaaactgtccagatggaagaagaagaggtagtaaaaggaagtgatgaaattgaaaactctgaattcagcattgatgtggacgaattctttgacttctcaacggaaggttgctttggtttggattgggtgaataagttccttgaacttgatgaccaacaggatccattagcaatggtataataagtttgtaattaacatgtttccttgaataaataaataaataaagagatgttctcaggcattatctcgtcttattattattatttttcaatcattctcctttccccctcatttttcatctgagacagtcggattgttcggattgttgttatgcctttatttgcattttgtgatgatcattaatttagttgggaacttatggctaaattgtaactaaaaaactggctggttggatatataattcctttggattaaaaaaaaaaaaaaaaaaaaaaaaaaaaaaaaaaaaaaaaaaaaaaaaaaaaaaaaaaaaaaaaaaaaagcaaacggggggacggcccaa

SEQ ID NO: 475 - DNA, 991 bp, Gossypium hirsutum
caattataataataagaacaaacccggtactcgacccacgcgtccgctgtgtgtctgtgtaaaaatatggggaggaggccttgctgtgccaaagaagggcttaacaaaggagcatggactgcaaatgaagaccaaatcctcaaaaactacatcaccatccatggtgaaggcaaatggagagaccttcctcaaaaagctgggttgaagagatgtgggaagagttgccggctccggtggctgaattatttgaggccggacattaagagagggaacatctctattgaagaagaagagctcattattagactacacaagctccttggtaacaggtggtctctgattgctggaagattaccggggcgaacagacaatgaaataaagaactattggaacacaaatttgagcaaaaggatggaaggccagaaaaggaatatttctccaaataccccccaagtttcttctcacaatgtgatttggaccaaagcagtgaagtgcaccaaggccgtcaatgttgatactttagaccccaaatccgaaactctagtcaacagtcctagtgagaccccttcttcttcagccatcaatgaggataatactaacaacaattccatggatttcttagtcgatttcgatatcgatgaacttctcgcattcgaatacaacccgatcccggagttgtatcgaactcaaaaccgcggtgacaaaatgggcaataatgtggcggacaacggggagtacagtcatggtaccgagttttgtcaggcatgtgaacacttggatcttcgaggtctagaatcttatttgaatcttgaagatgaatggatcaactaattaataatccaaagttcgcactttgttgtattaagatttgactgttaggtttgttagtgtttgaatcatattgtatcctataaatatccatgagaaatagcaataaaatatgggtccatttttgtaatttcaaaaaaaaaaaaaaaaaaaaaaaaaaaaa

SEQ ID NO: 476 - DNA, 1133 bp, Gossypium hirsutum
gaagtctttttaagttgatgcatggggtcatcctccatttttatgggtttataaatagagggagagagagagagagagagagagagagagagagagagagagtttaggagaaaatatgggaagaagtccatgttgctccaaggaaggactcaacaaaggagcttggactgctttagaagataaaatacttgcatcatatattcatgttcatggtgaaggcaaatggagaaacctccccaagagagctggtttgaagagatgtggcaaaagttgcagacttagatggctgaattatcttagaccagatattaaaagaggcaacatctctcatgatgaagaagaactcattataagactccataatcttcttggcaacagatggtctttaatagctggaaggctacccgggcgaacagacaatgaaatcaagaactactggaacactactttaggtaagagagctaaagctcaagcatccattgatgctaaaacgataccaaccgagtctaggctcaatgaaccctcgaaaagttcaactaaaatcgaagtgattcgaactaaagctattaggtgtagcagcaaggtgatggtcccattacaaccacctgcaactcatcaacatggtcaacatcactgtacaaataataatgaagaaatgggtggtggtattgcaacaattgaagctcacaatggaattcaaatgctcgagtcattgtacagtgatggcggctcaaatttgttgagcttcgagatcaatgaactgttgaaatcacacgatggtggagaatttgaggagaatcctatgcagcagcactttccgttgggtgaggcaatgcttaaggattggtctacatgtcattgtcttgatgacaatggtgccactgatttggaatcattggcctttttgcttgacactgatgaatggccatgatacgaatatcagtactgctacagtgaaatataaaggcaatcatttcaccgtatatcttttttccttaagattagaaaaaaaatgcttctttttgcttgttggaaggatgcatgttatgacaaaattactgtaattttgggtgttgaaaaataaataactcatccacgtgtctggttaatgctaaaaaaaaaaaaaaaaaaaa

SEQ ID NO: 477 - DNA, 1070 bp, Gossypium hirsutum
gaaacaatacattcatatgtttctttcaaacacaacaaacataaaaagaaccatcaggtttgatgaattaagtttggcaacaacatgatttaaacatacaatcaacacactttgaaaaaaaactatataaataacattcatcatcaaaccctctattgggtcattttggttgatcgaagggagtagattcccatccttgtgagagtcccaaattcgaaaccaatgcatcatcatcttcatttatcaatgaattcagaaaagaagagaacacatcatcatgatcttgttgttgctgataatggtcattgttcatgatcatcccttgatggtcttcattgctcccatcgtcataataattttgcttgttagcgttgacgacatgaacaggaagaggggaaggaggattgtttggtttcgccatggatgatgatgaagaaggtgaaggtttgagtgatggtggtgatggtgagagttgttgagggtttaaaggcttgtgcgttcgaggatcgatcccttgacttatcaatttcttactcaggtgagtattccagtagttctttatttcgttatctgtacgccctggtattcttccagctattagtgaccaccgattccctaaaaggcggtgaaggcggaggatgagatcttcttcatcgggagcaatctggccacgtttaacagaaggtcggagataattcatccatcggagacgacagctttttccgcatcggagaagaccagcccgtttaggtaaagtccgccaccgtccttcgccttctttgttgatgtaattagataataactcgtcttcttccggcgtccatggccctcttttcaaccctactttgctgcaacacggcgtcgtcttggttccaacgttgtcttttttcgtagggtttctcatggtttttttttttagcttagagagataactattttgatgatcggcgatttgatattagcgatagcttctatttcttttgtcatttaatttttcttacactgttttggaagtactgtcgtggctgtttggattttgaatcttcacttgcttaccatttattgtgaat

SEQ ID NO: 478 - DNA, 1168 bp, Gossypium hirsutum
cccacgcgtccgaaaaaagaaagaaagaaagaagtgtgaaaaaaaaaaatgggaaggagtccttgttgttctaaggaaggccttaacagaggagcttggactgctcttgaagacaaaattcttaaagattatatcaaagtacacggtgaaggtcgttggagaaatctccccaaaagagctggtcttaagagatgtgggaaaagttgtaggcttcggtggttgaattatttgagacctgatattaaaagaggtaacatatcacctgacgaggaagagcttatcatcaaactccacaaactcttgggaaacagatggtctttgatagctgggaggcttccaggacgaacagacaatgaaataaagaattactggaacaccaacttaagtaaaagagtttccgatcgtcaaaagtcacccgccgctccttcgaaaaaacccgaggcggctcgacgaggaactgctggtaatggcaataccaatggtaatggtagtggtagttcctcgacacacgtggtgcggacaagggcgacaaggtgctccaaggttttcataaaccctcatcaccacacacaaaacagacacccaaagccttcctcaacttgttcaaatcatggggatcaccgggaacctaaaacaatgaatgagttgttattaccgataatgtcagaatccgagaatgaagggacgaccgatcatatatcatcggattttacatttgacttcaacatgggagagttttgtttatcggatcttttgaattccgatttctgcgatgtaaacgagcttaattacagcaatggttttgattcgtcaccctcaccggatcagcctcctatggatttctccgacgaaatgctaaaagagtggacggccgccgcctccactcactgctgtcaccaaagtgcggcttccaatctccagtccttgcctccatttattgaaaatggaattgaatgaccttgaaaaaataaaagacgaaaaatattttctcatgtaaactaaataaacacatcttccatcaataattctgctcttcttcttcttcttcttctttgtgtgtgtggggtttaagtctctcaaaggactgttttgtcgacgaattttccataagatttccacgtgggaatgttggcttgttaaaaaaaaaaaaaaaaaaaaaaaaaaaaaa

SEQ ID NO: 479 - DNA, 1606 bp, Gossypium hirsutum
tttttattcggtacacacttgcttacgaaaatcaagttttaatgctatcgtcccttttgttgctactatccgcaagtcaaactgctaaatttgtttgtttccttctattattttagccaaggatagaccaagttatccgcattttggccctgatttcccatcttgactagctggtggtggcagttacacatagggagatggggagggcgccttgttgcgaaaaagtggggttgaagaaggggagatggacggcggaagaggatgtgttattgaccaagtatattcaagctaacggtgaaggctcctggagatcattacccaagaatgcaggattactgaggtgtgggaagagttgcagactaaggtggattaattacttgagagctgacttgaaaaggggaaactttacttcccaagaggaagaagtcatcattaacttgcatgctactttgggaaataggtggtctttaattgccagttacttaccaggaagaacagacaacgagattaagaactattggaactctcatttgagtagaaaaatccatagctttagaaggccattaactcaaagcatgccagtcatcatggacctcaccaagacggccgtgattgctaagcggaaaggaggtagaactagcgaagggtcgatgaaggaaaacaaaagctgcagtacccagaaagatactggaagttgttcaaataaacctactgaaaacgtttgtgttaatgaagttgagccattcccatccactccattgttagaaaaagaaaccttgtccactacagccattgaagatcgcatggtactggatcaacatggagaagataaggagagaacaacccatgttgtacccagtccttgtcacgacaccgttgttgaaggaatgttgggttcaagcgaggagagagagagcctggtgactgaggaaggaaccatagagaattcaatgcagtgccctagtggcaacgctgagaaagggactggtattttagcaccacatgagagtattgatagcagtgagatagagtggtttaatgatatcctggatagtgaattgctacagccaagtgggcatttgacgtttactgaactaggagaggacaggtggaatgtgaaaacacacacaactgcagctaataacgaggaaatagtgagtaggaactgtagtgcagatagtggtggggtcttgagctcatgtacttcaacaacattttactttgttgatgattgggaaaatgttgttccaagaagtgagctttgggatgagaaggaatacatgtgttcttggctgtgggagccaagcgactatcatgggaaaggagagagacataaagtggatgataatggctttgaggggcacaatcccatgattgctgctaacgtcgcttttctcctaatgctcctccttgttcctcctgctttagtgtctagctacacttccatgtcaatattttatctaggtagacagtgtgaacatgtcctgccgttttttctttttgttttacttttagattttgcttctcttttcaattctgatgctttgttttctttgtaaactgatttgtgatggaaaaaagattgaagaaaacattttcaccgaat

SEQ ID NO: 480 - DNA, 743 bp, Gossypium hirsutum
gtttatagttcggcaggttgctatacaatctgatgcggattccttatacatcatatcctgaatacatcctggccaatttggttcatgctcttgctcatcattcatgtccgaacacagatgaatgcaaagatgtcaaagcatttgaattaatattccggcaattgtacttgactatttctatgttggtgaaaaaagagaggaaatattagattatagatttgaggctcgttacccccgccccccaaaataaaaaaccttgacccctgttaccaagggaatgtccactcttattgaagaggagattgaggtgagaaaagtggccatggaccacggaagaggatacgctcctaacccattacattggtcgtcatggggtaggtccttggaatatgttggcaaaatgtgcaggtaccaacacattgatcaacaaactctttacccttttctttatgttctgggttgatctacctttaacttcctcaggtcttaagagaagtggtaaaagttgcagattaaggtggcttaactatttgaaccctgacattaagcgcggaaacctcactctccaagaacaacaattgattcttcaacttcattccctgtggggaaatcgatggtcaaaaattgcagagcatcttccgggaagaacagacaacgagatcaagaactattggagaacaagggtgcaaaacaagcagccatcctcttcttctttgaaagaaatgagctcccaattttcagtc

SEQ ID NO: 481 - DNA, 416 bp, Gossypium hirsutum
aaaaaaagagaggaaatattagattatagatgtgagggtcgttacccccgccccccaaaataaaaaaccttgacccctgttaccaagggaatgtccactcttattgaagaggagattgaggtgagaaaagggccatggaccacggaagaggatacgctcctaacccattacattggtcgtcatggggtaggtccttggaatatgttggcaaaatgtgcaggtcttaagagaagtggtaaaagttgcagattaaggtggcttaactatttgaaccctgacattaagcgcggaaacctcactctccaagaacaacaattgattcttcaacttcattccctgtggggaaatcgatggtcaaaaattgcagagcatcttccgggaagaacagacaacgagatcaagaactattggagaac

SEQ ID NO: 482 - DNA, 1389 bp, Gossypium hirsutum
atgcagctttcaacaagcaaagtagcagtattttctctaagaatagatacaaccaatattgattaatttccaccctatgtttggaaattgatattcctacaaaagctaaattcatccgtctcgagcaaaagggccaaagaatcaaaatccatggcgtcattgccattaagacaaggatttacggtccaattcttaaacattgcctcatcaaaggctaagggttgcatagggttctcctcaaattcaacatccctttcctttagctgctcatttaacaaatctgtgccgccaccatcactgtacaacgaatcaagcacttgggttccatttatgttgagctgcaggtagctgtgttgggatcctgaccttgctgctggacctagtggctttagttagaatcactttgatttttgctttcgtagcccggagcgaacgcaagggttcacagtctccagactcggttgatagcattttatgtgtagatttgcttggaggagttccaatggatgcttgacctttggctctctttctcaaaacagtgttccagtagttcttgatttcgttatctgttcgccccggtaaccttccagctattaacgaccacctgcacagcatcacacaatgagcagtaaggaactcagtacctcttaatttcgattcccattgtaaaaaagaaggggagagagagattaacaacctgtttccaagaagattatggagtctgataatgagttcttcttcatcacgggagatgttgcctcttttgatatctggtctaagataattcagccatctaagtctgcaacttttgccacatcttttcaaaccttcattttgggggataataaaccatcaaaaggcatcaattgaaaagcttaattacaataatttcactttggggttttatatatatataccagctctcctggagaggtcgctccatttgccttccccatgagctttaatatatgatgcaagtaatttatcctccaatgcagtccaagctcctttgttgagtccttccttggggcaagatggactcctccccatatcgctcttttgtctctctctccctctaccttaaaaccattttaatggaagaggacctttccccttttatagcccatagtctttctgtgtgcatgtatatatgtatacacacatatatatacatacacggtggtgaattgcactaagttatcgcgtctaataagatttttaaaattttaataagtttttttttgagaaaagaatatctaaatattctttagagaggttgtatattaattgttgacttcatctgttaatcttatgattaaagatttaatctctacttatgaaaataaaatacattgtatgattaatcatcaaaaaaaaaaaaaaaaaaaa

SEQ ID NO: 483 - DNA, 797 bp, Gossypium hirsutum
ctcgtaacatgcagcttgcaacaagcaaagtagcagtattttctctaagaatagatacaaccaaagattaatttccaccctatgtttggaaattgatattcctataaaagccatattcatccatctcgagcaaaaaggccaaagaatcaaaatccatggcgtctttgccattaagacaaggatttacggtccaattcttaaacattgcctcatcaaaggctaagggctgcataaggttctcctcaaattcaacatcgctttcctttagctgctcatttaacaaatctgagccgccaccatcactgtacaacgaatcaatcatttgggttccattgtagctgtgttgggatcctgaccttgctgctggacctagtggctttagttagaatcactttgattttggctttcgtagcccggggtgaacgcaacggttcgcagactccagactcggttgatagcattttttgtgtagatttgcttggaggagttccaatggatgcttgagctttggctctctttctcaaaacagtgttccagtagttcttgatttcattatctgtacgacccggtaaccttccagctattaacgaccacctgcacagcatcacacaatgagaaggaactctgtacctcttaatttcgattcccattgtaaaaaagaaggggagagagagattaaaaacctgtttccaagaagattatggagtctgataatgagttcttcttcatcatgggagatgttgcctcttttgatatctggtctaagataattcagccaaaaaaaaaaaaaaaaaaaa

SEQ ID NO: 484 - DNA, 916 bp, Gossypium hirsutum
atcatatattaaaactcatggggaaggcaaatggagcgacctctccaagagagctggtatatatatacatataaccccaaagtgaaattattgtaattaagcttttcaattgatgcctttggatggtttattatcccccaaaatgcaggcttgaaaagatgtggcaaaagttgcagacttagatggctgaattatcttagaccagatatcaaaagaggcaacatctcccatgatgaagaagaactcattatcagactccataatcttcttggaaacaggtggtcgttaatagctggaaggttaccgggtcgtacagataatgaaatcaagaactactggaacactgttttgagaaagagagccaaagctcaagcatccattggaactcctccaagcaaatctacacagctacctgcagctcaacaaattgataagcttcgagatggtcagcttaagtcaacaaataataatcaagaaatgagtggtgatattgcaacagtggaagctcacaatggaacccaaatgattgattcgttgtacagtgatggtggcggctcagatttgttaaatgagcagctaaaggaaagcgatgttgaatttgaggagaaccttatgcagcccttagccttcgatgaggcaatgtttaagaattggaccgtaaatccttgtcttaatggcaaagacgccatggattttgattctttggcctttttgctcgagacggatgaatatggcttttataggaatatcaatttccaaacatagggtggaaattaatctttggttgtacctattcttagagaaaatactgctactttgcttgttgcaagctgcatgttacgagttattgctgtaaatctggagtaaaattgaaagctgaatataataaactcataaacgagtatggttaatcctg

SEQ ID NO: 485 - DNA, 1188 bp, Gossypium hirsutum
gcatctccttgctgctgcatcatttttctcttcttctctgtcactaagcaataaacatgggaagagcactttgtggtgataaaaatgggctcaaaaaagggccatggactcctgaagaagataaaaaattgattgattatattcaaaaacatggttatggaaattggaggacacttccaaagaatgctgggttgcaaagatgtggaaagagttgtcgtcttcgatggactaactacttgaggcctgatatcaagagaggaaggttttcttttgaagaagaagagactataattcagctacatagtatattgggcaacaagtggtctgccattgctgctcggttgcccggacgaacagataacgaaataaaaaactattggaacacacacattagaaaaattcttcttcgaatggggatcgatccggtgacccatactcctcgactggatcttctcggtctctcttcccttcacaatcaatatcttatccagtcttttgttaaccctgagcttcttcataatgttgaccaatatcaaccattgacgcaatctaaccattgccacgcacaagtcgaagaaacccaaacttgtagtgttccattttataacgaagaactacaactcgtgatggaacccaatgtaaaccaattcccatcaaatttcaatgactatgttatgccttcaattttgactgaagattacgtgccgctaccgccgcagtacaactattacggctcggattatcaaaccgtaatggacccttcaatcgaaacctcgaatttccatcccatcaacagcaaccagagcttggggttggggtcagttgtgtcgacgccttcgtcaagccccgccccattgaattcaaactccgcatacctcaacagtagcagcaccactgaagacgaaacggaaagctattgcaccaacattttgaagtttgaaatccctgatattttggatgttaatgatttcatgtaattccaaatgcataactcccaaaaagagtttttcttttttcttttttttttgattagtgagacatgttgatacgtgtgaaaatttctactaattaatagttgatttctctcaagatcactgtgttagaagcaagatcatacatccgttctgtcctttttcttttcaaaaaaaaaaaaaaaaaaaaaaaaaacaaaaaaaaaaaaaaaaaaaa

SEQ ID NO: 486 - DNA, 1118 bp, Gossypium hirsutum
gctataaaaggggaaaggtcctcttccattaaaatggttttaaggtagagggagagagagacaaaagagcgatatggggaggagtccatcttgccccaaggaaggactcaacaaaggagcttggactgcattggaggataaattacttgcatcatatattaaagctcatggggaaggcaaatggagcgacctctccaggagagctggtttgaaaagatgtggcaaaagttgcagacttagatggctgaattatcttagaccagatatcaaaagaggcaacatctcccgtgatgaagaagaactcattatcagactccataatcttcttggaaacaggtggtcgttaatagctggaaggttaccggggcgaacagataacgaaatcaagaactactggaacactgttttgagaaagagagccaaaggtcaagcatccattggaactcctccaagcaaatctacacataaaatgctatcaaccgagtctggagactgtgaacccttgcgttcgccccgggctacgaaagcaaaaatcaaagtgattctaactaaagccactaggtccagcagcaaggtcaggatcccaacacagctacctgcagctcaacatactgataagcttcgagatggtcagcttaactcaacaaataataatcaagaaatgagtggaaatattgcaacagtggaagctcacaatggaacccaagtgcttgattcgttgtacagtgatggtggcggcacagatttgttaaatgagcagctaaaggaaagggatgttgaatttgaggagaaccctatgcaacccttagcctttgatgaggcaatgtttaagaattggaccgtaaatccttgtcttaatggcaatgacgccatggattttgattctttggcccttttgctcgagacggatgaatttagcttttgtaggaatatcaatttccaaacatagggtggaaattaatcaatattggttgtatctattcttagagaaaatactgctactttgcttgttgaaagctgcatataataaactcatcaacgagtatggttaatcctgaccttgatgtttttagaattcttcatccaaaaaaaaaaaacaaaaaaaaaaaaaaaaaaaa

SEQ ID NO: 487 - DNA, 997 bp, Hordeum vulgare
ccgcccacgcgtccgctccttctccttccactcatcagctagctccacagttccacttctgcgacagctccccgagaagagccctagctagcttcgtcttcatcgcgcctcaccggaaggcatggaccgcaaggacaagtctcgcaagtccccctcagcagcgtccatggcagcgctcgccgcggcagctgcggccggcgacgtggcccaagccaacgggatgtccggtgaggaggaccagaagctgaagcttgtgaacgttcccgtggtttccgtcggtggctcgagctcctctgctgcggcggtggcggtgaggaggggcagtggtgctgctggcgccgtggcaacgggcgcggctggggcaggcgggccgagctgccaggccgagaggtgcggcgccgacctcaccgaggcgaagcggtaccaccgcaggcacaaggtgtgcgaggcgcactcaaaggctgctgtcgtggtcgtcgccggtctgcgccagcgcttttgtcagcaatgcagccggttccacgagcttctggagttcgacgaccaaaagcgcagctgccgccggcgcctggccgggcacaacgagcggtcggatgaagaactcggctgaggcgaacggcggggaacggtgcccccaccccccaaccagacggcccggatcccaccctgggaaccccgcccgttgacccatttccagatcagaataaccctacctaaacctgcctccctgtcttctgtcatgcagccatgctactagctacaaatatctacatatgtatccacccacctacgtaggtacgtacctacctacctatgtctccactatccagtcccagtgtactaagtggcagtatatactgtctcctgtactgctatatgcttgcgtctgtccgccaaaaacctaagctaagctaattgtgacccgggaactagtccaggtgttagagtgattgtctgtgtgatgtgtaattgtatggcctgtgcagccaagacttct

SEQ ID NO: 488 - DNA, 872 bp, Hordeum vulgare
  misc_feature (615)..(615): n is a, c, g, or t
  misc_feature (632)..(632): n is a, c, g, or t
  misc_feature (678)..(678): n is a, c, g, or t
  misc_feature (683)..(683): n is a, c, g, or t
  misc_feature (713)..(713): n is a, c, g, or t
  misc_feature (815)..(815): n is a, c, g, or t
  misc_feature (832)..(832): n is a, c, g, or t
  misc_feature (838)..(838): n is a, c, g, or t
cggcacgaggctccaagacccccgtcgtcaccgtcgccggccgcgagatgcgcttctgccaacagtgcagcaggtttcacctgcttacggagtttgatgaggccaaacgcagctgtagaaagcgtcttgatgggcacaaccgtcgccgcaggaaaccgcagccggatccgatgaattctgcaagttttatgacgagtcaacaaggaacaaggtttccatcatttccaactccaagaccggagcaaaactggccagggatcattaaaactgaggagaacccctattacacacatcagctccctctaggcatcagtaacaggcatcattttggtggctctacatctactttcgcgaaagaaggacggagatttcctttcctacaggagggcgaaataaactttgccaccggtgtggcacttgagcctgcagtgtgccagccgctgctcaagacggtagctcctcccgagagcagcagcagcagcagcaagatgttctccgatggtctgactccggtgctcgactcggactgtgctctctctcttctgtcagctccggcaaattcctccggtatcgatgttggccagatggtccaacagactgaacacatccccattngcccaacctctgttctncaacctgcagcaattcagcagctcgtcctgggtctcgcgcacccangcttncaccggcaccgtctcagcgacccgattttncttgcccgtggtggaaaatgagcagctgaacaattgtctacctcggacaacaatgacttgaactatcatgggatttttcatgttcgaagcgaaagcttctanaacggcgcttcgcattntttgcncttcccggggaagagttttcagtggctggtcatg

SEQ ID NO: 489 - DNA, 647 bp, Hordeum vulgare
cgggctgagggctcctgcactcaaggcgccgctcgtcgtcgtcgccggcatcgagcagcgcttctgccagcagtgcagcaggttccaccagctacctgaatttgaccaaggaaaacgaagctgccgccgacgcctcgcgggtacaatgagcgccggaggaagccgccgcccggacctatgtcgacacgctatggccggcttgctgcgtccttcaacgaagatccaggcaggttcagaagctttctgctggatttctcgtacccgagggccccggccggcgtgagggacccgtggccggccgttcagcccggcgaccaccgcatgcctggcaccacccactggcagggccagggcagccatcatgaacaacaccacgctcatcgcagtgcagttgcgggatacggcgaccaccacgcgtacaacggccagggcagcagctcggggggaggcggggcgccgatgatcccggcgggcttcgagctcccctggacaagatggcgggcgtcgccgccgactccagctgtgctctctctcttctgtcaactcagccatgggatagtagtgcccacagctccagccacatccggtccccggcaatgtcgacggccagcgccttccagggcagccccggtggcgccctccgtcat

SEQ ID NO: 490 - DNA, 532 bp, Hordeum vulgare
cggcacgaggaaagcgccttgatgggcacaatcgacgccgcaggaagccacaggtagatagcatgaattctgggagcttcatgacaacccaacaaggtttgtattcaaatgcagggccgcgcgtcgcgtccttctcggctccaaggccggagccaagctggtccgggatcatcaaatccgaggacagcaatccattctacagcacgcaccaggttaacttcggcggcgccacgtcgtcatactccaaagaaggccggcgcttccccttcctccacgaaggagaccagatgagcttcagcaccggcgcgccggcactcgagatccccgtgtgccagcctctcctcaaggccgtcgccccgctgccgccgccgcccgagagcagcagcagcaacaagatgttctccgatggacagttgacgcacgtgctcgactccgactgtgctctctctcttctgtcatccccggccaactcctccagcgtcgacgtcagccggatggtccgtccaagcgagcacgtcccctctgtccccag

SEQ ID NO: 491 - DNA, 774 bp, Hordeum vulgare
gcagaagcaattcagaaacatagcaagttcagaattattcagacaagtggctaaatgatggatcaagatcttcttccatggcaacacaaccgggtcaatttgatcctaagtctgttcgtgtgcgcctttattctaggcattgccaaaccataagcctctaggcaggcaacggcaccaagcaaagaaaatgcaggatcccgggtttcagaccgaacaaacggcgtcgatcgcgtgataaaatcacgcaccgagcggggtgaccggatcggagcgccgtcgtcatcagtgcatccggtcgaagtgcgaggcgtggtcgtaggaaggctttgggagctggagctcgctgtcgtggtcccccaagcgctcgaagacctggaaccgcgggtgatcatctaggggtggcccgccgtctagccagagccctgccgatgatcccagcacgtgcatcgcggggttgggggtgccggcaatggcagccaccccagagtgcatctgggaagttggctggaggttggcagcacccactgggttgcttgacagaagagagagagcatgctgaagatccggggcgccactagagttgggggcgacagcggaagcttggacaccttgattagggaactttgtagaagttcccttgaatgccatgaacccatcgaaaccatgatgtgcaccatgcggcataacattgtccgacatctgctgactagataaatgcatcccatcaacacctgcagcagttgttggctttaaccaaggagcttttgtgtgtgc

SEQ ID NO: 492 - DNA, 2107 bp, Hordeum vulgare
  misc_feature (2082)..(2082): n is a, c, g, or t
gagtaatcgattagttctgattaaccaaatgagaaaagcggacagacagactccatttcagataaactccatgatagtacagagaatgcatcggttccgatcactgaacactgatctctcatcatcatccttctatacaacaaggtaaatgactaaccaaaatggatcgaagaaagctacccggcgcatgatcagcgttcttgctggctggctactggtttcctccacggggcgggccggaaactcttccctgttagcaatccctccgatgcagcgaagatggcgcacgcagatgtagagagagagagagaaaaagaacgatcaaatcatctcatcaggagcctaaatctgtggcaagtctagcgcgccgtcatggttgttgttgtcgtcgctgccgctgccgctgccgccgccgccctccatgaacagtctgagccagtagtccatgtcgccgtcgggcttgccgaacgcgtcgtggggctccatgcagacgtcgttgaggtcgtccagcggcatggacagcgtctccgaccagaagctctcgtcgatctggaactcctccgactcctcggacgaggtgaagcactcctccttgacggacgcggacgcggacgcggagctgctccccgagttgccgtgctgctccgccgccgccgaggcggtcgacgtcgactcggtgaccgtggatgagacggagcgctcgggcgaggacacgggcgccgccgccgccgccctggcggtcagcgcgttgaggttcctcatcttgaccttgccgtcgcgcttcctcggcgccgccgccgccgccggcggcttcttgcgcttcttggcggcgccggcctcctcttgctgctcctgcgcgctggggtcgagccgcttcttgaggtgggtgtgccacacgttcttgatctcgttgtccgtcctccccggcagcctggcggcaatcgcggaccatctgttgccgagcagctggtgcagctggatgattgactgctcctcctcgtcggagaagttgccgcgcttgatgtccggccgcaggtagttgatccaccggagccggcagctcttgccgcaccgcagaagcccggcttgcttgggcagcgcgcgccagttgccgtggccgtggctgtggatgtgtgcgaccaggatcttgcactccgcggcatccacaggcaccccggccaggctagccgtgcccgtgctcccttcttctcttctccccccaaagagtcaaagacaggcacagaggggactcgcgcatccagcacgcacgcgcgcacgcatccggatcgagaagatggggagggcgccgtgctgcgagaagatgggcctgaagagggggccctggacgccggaggaggacaagatcctggtcgcacacatccacagccacggccacggcaactggcgcgcgctgcccaagcaagccgggcttctgcggtgcggcaagagctgccggctccggtggatcaactacctgcggccggacatcaagcgcggcaacttctccgacgaggaggagcagtcaatcatccagctgcaccagctgctcggcaacagatggtccgcgattgccgccaggctgtccggggaggacggacaacgagatcaagaacgtgtggcacacccacctcaagaagcggctcgaccccagcgcgcaggagcagcacgaggaggccggcgccgccaagaagcgcaagaagccgccggcggcggcggcggcgccgaggaagcgcgacggcaaggtcaagatgaggaacctcaacgcgctgacccgccagggcggcggcggcggcgcccgtgtcctcgcccgagcgctccgtctcatccacggtcaccgagtcgacgccgccccccgccgccggggagcaacacggaactggggagcactcccgtccgggtccgttctaaggagagggttactttcccagagcgggggatcaaacgaaagagtctgtggagagctgcttccctgaacctaaacgttgtggagccagacttgggagccgggagggatattttattgttggggggggggtggtgggaggaaaacccgagggcaaaaacaatagcgagaagagaggntttttcttaaggagcacagagggag

SEQ ID NO: 493 - DNA, 1177 bp, Hordeum vulgare
caggctagccgtgcccgtgctcccttcttctcttctcccccaaagagtcaaagacaggcacagaggggactcgcgcatccagcacgcacgcgcgcacgcatccggatcgagaagatggggagggcgccgtgctgcgagaagatgggcctgaagagggggccctggacgccggaggaggacaagatcctggtcgcacacatccacagccacggccacggcaactggcgcgcgctgcccaagcaagccgggcttctgcggtgcggcaagagctgccggctccggtggatcaactacctgcggccggacatcaagcgcggcaacttctccgacgaggaggagcagtcaatcatccagctgcaccagctgctcggcaacagatggtccgcgattgccgccaggctgccggggaggacggacaacgagatcaagaacgtgtggcacacccacctcaagaagcggctcgaccccagcgcgcaggagcagcacgaggaggccggcgtcgccaagaagcgcaagaagccggcggcggcggcggcgccgagggggcgcggcggcgagggcaagatgaggaacctcaacgcgctgaccgccagggcggcggcggcggcgccgcgtgtcctcgcccgagcgctccgtctcatccacgggcaccgagtcgacgtcgaccgcctcggcggcgccggcgaacagcacggcaactcggggggcgggcccccgtccgcgtccgcgtccggcaaggaggagtgcttcacctcggccgaggagtcggaggagttccagatcgacgagagcttctggtcggagacgctgtccatgccgctggacgacctcaacgacgtctgcatggagccccacagatttaggctcctgatgagatgatttgatcgttctttttctctctctctctacatctgcgtgcgccatcttcgctgcatcggagggattgctaacaggaaagagtttccggcccgccccgtggaggaaaccagtagccagccagcaaaaacgctgatcatgcgccggggagctttcttcgatccattttggttagtcatttaccttgttgtatagaaggaggatgatgagagatcagtgttcagggatcggaaccgaggcattctctggactatcatggagtttatctgaaatgggagtctggctggccgctttgctcatt

SEQ ID NO: 494 - DNA, 875 bp, Hordeum vulgare
tacggccttttgattcacccgaatctgaataacaaaggaatagggaatatgcacaaataggatggtatgtcctataatactctctccagcacataacaccttgctccattctcacctcctaaaaaaaaaactctaagttccgttctacccggaccttccggtcgactgccagtttccctctccgatgttccacggaaacccactcagacgcaccggcggcggcggtccgatgtgctatttcccggacagcactcctgcatgcatacagggagccaggcatgctcaattcagtatatctttatcacatctccaccttaacaaactgcagtcgagtctgtcaccgcacggacttcaccaggtcgatcacggcgggcaaccgaagatcgccgcggggcttatcattgatcaccagtctgctccagacgacatctcgggcatgctgaccattgtcaatcaccagaaccacaacaattcagatgtcaagagtgcttcaccccaacttatgctctttggaaaaccctactcccttatcatctcatcactttaggtaactcacaaggcttctctccatctgctgctaagaacagcacctctggtattatccccccaaaagtcggcaaataactttgattttcaaggccccaaaggcccccaaatggcctctttaaaaaacctcgcccttggaaaaattccattgtccccgcaccccaatggacctcagctcccgacttgaaattttgccctttccctaacttcttgcccccaaaaaaacctcaatcccccacttaaccttacaaagtttgccctcgtttggagaattatatctgcggcatttcccccctcttttggacgctgcaaaaaggctttcctttttc

SEQ ID NO: 495 - DNA, 592 bp, Hordeum vulgare
gtggaacttgtatcaagcattccaccaatccatttgggaccattttccccaccacgaaagaagttacgggttccccagcatcctgattttccattggatggccatctgttcaatccaattttccatgggaacccacttggtcctacaacagccccctatgctgttactcggacaacaactctcctgcaggcatacagggagccaggcatgctcaatttggtttaccattaacagaccatcagcttaataagctgcaccttggtctgttccacggcggcggttttaacgggcttgacgcactaaccccgtcttcccggatacctaagggcttggtgctcagcagcgcacccgcccatgacagtgtctcttgtttgttgacaatcggtacaccacagagcacagaaaaatctgttgacagaaagacaccacatataatgttgtttggaaaggctattcttacggagcagcagatgacttcaagtggatcaagagagacgctctcctcgggggctactggaaacagttcacctatcagtgctgcactgaaggcaggaaatacgtctgatggttcgggttcatcgatttgcattgg

SEQ ID NO: 496 - DNA, 1319 bp, Hordeum vulgare
ggcatggcatggcatggcatggcatggcgacctggatggaagtacgtaggtacgttacattcgatgatgctgatgatgatcatgaaaggtactgctgctaggagtggtatccagagtggtactgctgctgctgctgctgctgctacattgatttgtttgcagctcctgcctacggtacggctacgacgacgagaaaaatgcaaagggaaatgagctaactctcgacaaggaagaaaccacagcttgtacttgggctgtaggcgtggggtggtacttgctccggcttattgctcgctaatggaggtccaggggtcgccggcgacctaggttattcggctcaagatcgatggatgttgctgcttgcctcccttcctagcccccaatgttgtcgctccccgcgtccgccaggatcatcagcctccgggccgacttcacgaacgcgctgaaaggttcatcgccgatgtgcttcacctcgccggcggcgctgcggtagagcacgtggttcctcacttcagcgcggtccatgccgaacatgtcggacatgcggccgtacagctcctcgaacgagcccagcgccgagaggtccaggttgcgccccacggcgtccgactccacgaacaccttgcactgcccgggctccagccccagctccggcgccgcctggctgccgctgtccccgaaccactgcagcctccatgaggacgtgttgttgttgttgttgttgcttgggctgccctggatcacgccggagccggacccggagccttccgagaggttgggcgccttctccgcgtcccagttgggcgagccgcacccgccggccaccggcgaggacttcatctgctcctcggtcagtatcgcctgcccgaagagcagcagagtcttgacgtccccggccttctttggcggggtgcacgccctgacgtcgtcttcgcgggcgggcgaggtgccgatggtgaggtcggtgctgatccttggtgcgcggggagcaacgtggtcggtcgccgcgggcgggcggcgggcgccgccggagtagagcaggctcgactgcaggttgctggggtggagatccgaaaaggacggaccgaattgcgcatgcctggctccctgtatccctgcgagaggagcaccattgctgtccgggaaggggaagaaggggaagctgtggtgcatgagttgatcgtgcgccagcgggtggttgggcgggaacggcggcggcggcgggtggaagagctgcccgtcgaaggggaagtcggcgtaggacgggatccgcggcttcttgcgcggcggcgagaaggacggcaggtggaggttgggca

SEQ ID NO: 497 - DNA, 1516 bp, Hordeum vulgare
ttcggcacgaggtcgagacggaggactcgtcgaggatcagctggttcatggggactgtgtcggtcgtgcaggtggccgaccccattagatggcccaattcaccttggagacttcttcaggtgacttgggatgaaccggacctgctgcagaatgtgaagagggtgagcccatggctggttgagctggtctcaaacatgccggccattcaccttgctccgttctcgcctcctcggaagaagctctgtgttccgttctacccggaccttccggtcgacggccagtttccgtccccgatgttccacggaaacccactcggacgcggcggcggcggcggtccgatgtgctatttccctgacggcactcctgcaggcatacagggagccaggcatgctcaatttggtatatctttatcagatctccaccttaacaaactgcagtcgagtctgtcaccgcacgggcttcaccaggtcgatcacggcgggcaacagaggatcgccgctgggcttatcattggtcaccagtctgcgcaagacgacatctcgtgcatgctgaccattggcaatcaccagaacaacaacaagtcagatgtcaagaaggcttcaccccagctgatgctctttggaaaacccatactcactgagcagcagatcactttaggtaactctcggggtttctctccatctgctgctaggaagagcacctctgatatgagcgccgaaaagtcggcgaataactctgatattccaagcccacaaagcaaccagaatggctctatgaaaaacttgtcctgtggaggagttccattgtgccaggacaacaaggtactcgatctcgggctggatatcgggcactgcaagatattcatgcaatcagaagacgtcgggcgcacacttgatcttacagctgttggctcgtatgaagagttatatcggcggctttccgacatgttcggtatggaaaaagctgagctgatgagccatgttttctaccgtgatgcagccggggcgctcaaacacactggagatgaacctttcagcgacttcacgaagacggcgcgtaggctgacgatactaacggacacgagcggcgacagcagcgtagcgagctagggggtgaggaaggaagcaagctctttcgccacttgtacgtgctacagctgggaggggcgcagcgccgcacggtggcggttctcagagagcgtagatagagtggcggcaaaccccgaatggcgagccaccgcggcctggatgcaagtcaagaagcaccaccggtgcaggcagcttcagtttttctccgattattagagaggtcccagaatgggacggatgattgtttgtgtgatccttggacacttttctttctttcgttgtgttggctggtacccattatgatgatgtagtagtagtaacgcaggcttggaatccatggcggttctccttgctggaattcctgggaggaatgaatgaatgtctgaacctttttcttcttctgtgatgaaaacatgcgtgtgtggtcc

SEQ ID NO: 498 - DNA, 2279 bp, Hordeum vulgare
aaaactaactctctccctcaaaaaagaaaaagaaaaaaaaaactctctctctctctcccctccctatctctctcacgcacagaggatcggtagcagtgcagcgatcgcgaagatgagctctattggcatgatggaggcgaagatgccgccggggttccggttccacccacgggacgaggagctggtcctcgactacctcctccacaagctcaccggccggcgcgcatacggtggcgtcgacatcgtggacgtcgacctcaacaagtgcgagccatgggaccttccagaggcggcgtgcgtaggcggcagggagtggtacttcttcagcctgcgcgaccgcaagtacgccaccgggcagcgcaccaaccgcgccacgcgctccggttactggaaggccaccggcaaggaccgcgccatcctcgcccacggcgccggcgaggcgttggtggggatgcgcaagacgctcgtcttctaccaggggagggcccccaaggggacgaggacggagtgggtcatgcacgagttccgcctggaggaggaacgacgccaccaccagccgcagcagcagcacaagggccgcgccgccgcccccgaggcgaggtgccagctcaaggaagactgggtgctatgcagggtgttctacaagagcagaacaaccagcccaaggccaccatctgaagaagcctgcacattcttcaccgagctggaccttccgactatgccgcccctcgcgcccctcatcggcgcctacatcgccttcgacagcggcaccacgatgaacaccaccgagcaagtgtcctgcttctccggcctgccggcactaccgctcaggggatcggtgagcttcggggacctgctgggctgggacaaccctgagaagaaggccatcaggacagcactgagcaacatgtcaagtaacaacaattccaagttggagttgcctccaaactggagccaggagaacggcttgccacagatgtggacacccctctgaatctttgatatgagattactgtgctgctagttgaagtgtggtggtgactagtaagtaattagatgacatattctttctaatgatattggagagtagtattggactattggttgatgcagtgtctgttcctagggatttgatggaaggtgtgtggtgatttacaaaccagtagattagtgaaatggcttgatatagcatctgtacataggaatgctataagaaatgtcctattttagttctactctttctatccactctccaaatgtaatgtaacttcccattgaaagtaaatatgtgtataacccctgtttgtcattataagaatcttcgatatatgttcctttatttgtacactcattcatacaaatttgacaacacaggtactgcaataatttcttcctttgtgatgtcccagtacaacaacttccgttgcacttctgctatactatctctttgtgaatcgatataatggtaggagacatgcatcatactgtcaaaatcaggcgtacaagctaccaatcgagcaacaaagtaaccgagtacgagtgcatggaccctttcgtaactctgactgaagtctcagctatctttttgtgtactgatggatcccgaggctttctccaggtccctcctgttcatgtaaaacaaggattgtttctccgagaacgctgattttatgctgattggtgaaaatcctgcgtattccttgtcgaccttagccaggccgacctcgagaatatacttcacgagttcatgtttttggacgaatggttgtgccgcaaattcctccaccggcatccactgagcatcctcactttccgactcttgcttagtaatgtcaacagaaagtggccttaggatgcacacaaaaaatagatccgatttttcaaaataagctttgtggctctgcctgaaggcaactacctcgacgaattctgcatcaacccctgtctcttctcttacaactccactttttatatcttcccctggttcaacaactccggttgggaatttccatataccaagccccttaagtacaccgtttttttcctggacaaccaatacctctcttttgtcattcattacaaaagctccaaggcccacacggtgagtagttgatgcatatccagtccttgactcttccaccattgaccaaatacagcacctgactgcaccatcaggatctgcttgtttaccaaggatctgcttgtttaccaagcctgaaaattacaccagcaccaaaccaagcctgacattcatgtttttggcgaatggttgtgccgca

SEQ ID NO: 499 - DNA, 1131 bp, Hordeum vulgare
cggcacgagggatccaaggcgcgcgtggtggcggcagcgatgagttcgctcagcatggtggaggcgaggctgccgccggggttcaggttccacccgcgggacgacgagctcgtgctcgactacctgtccaggaagctcggcggcggcgccggaccggcggcggccgcggtggcgagcatctacggctgccccgccatggtcgacgtcgacctcaacaagaccgagccctgggacctccccgaaattgcgtgcattggcggcaaggagtggtacttctacagcttaagggacaagaaatacgctacagggcagagaacaaatagagcaactgaatcaggctactggaaggccaccgggaaagaccgcctgataagccggaaagggttgctagttggcatgagaaaaaccctggtgttctacgaaggcagagcccctaaagggaagaagactgagtgggtcatgcacgaattccgcaaggaagggcaaggcgatcatatgaagttgccattgaaggaggactgggtcttgtgtagggttttctataagaccaggacaaccattgctaagccacccacagggagcagctacaagatttgacagtgcagtcgcaacctcactgcctcctctcattgacaactacattgcctttgaccatcctggaatgttgcaaaacctagagggttatgagcaagtgccctgcttctccaataatccctcctcacacccgtcatcgtcgacctcgatgagtatcccggggatggcgcccatggctgctgatcaggagcagcagcacatggggaaggcgatcaaggacgtgctgagccagctcagcaggtctgagcaaggcaacgtgaagagggaggcgcctacccagggtggtgtgtttgctcaagatgggttcgagtacttagctgagagtggcttctcacagatgtggaacacgctcagttgattttctagctatggatattattgctaccatttacaactctagatttccccgcaagcagtctcctgcatgtctgggcaatcagccaaacgcaacaaaatattatctatcagaactgatggcgctcggcatctggtcatgaaaatgaggaggcggcgattcctgccgctgcttgcacctgc

SEQ ID NO: 500 - DNA, 1348 bp, Hordeum vulgare
cggcacgagggatggagcacggcgagcaggagcagcacgccatggagctgccgccgggcttccgcttccacccgaccgacgaggagctcatcacgcactacctggccaagaaggtggccgacgcccgcttcgccgccctcgccgtctccgtcgccgacctcaacaagtgcgagccctgggacctgccaggtaagctagcaacacttctgcagttcatgcaccaacctgtgtgaccgatcgctgcgatagaacccacgaccacgagctgccgaattgatcaaacaacgccaacgcgtgcatgcagaattcggcacgaggggggagaaggagtggtacttcttctgcctcaaggaccgcaagtacccgacggggttgaggacgaacagggcgacggagtccggctactggaaggccaccggcaaggacaaggacatcttgaggggcaaggccctcgtcggcatgaagaagacgctcgtcttctacaccgggagggcgcccaagggcgagaagtccggctgggtcatgcacgagtaccgcctcaacgccaagctccacgccgccagcaccagccgcggctccctccccggcagcagggccgcgtcgtcctcgtcgtccaagaacgagtgggtgctgtgcagggtgttcaagaagagcctcgtaggcgtagtgtcgccggcgccggcgtcgtcagcagcaaggaaaagcggcgtggggatgatcgaggagataggttccaccgtggccgccgtcaccccgctccctccgctcctggacatgtccggctccggcgcctccttcgaccaggcggcgcacgtgacctgcttctccaacaacgcgctggaggcgggccagttcttcaacccgacggcgacggaccaggaccagcacggcctagccacatactccccgctagcaagcttcgcgcagtacggcgggcagctgcaccacggcgtgagccttgggcctgggggcaagcttccttcgggagcaagcgggtaccaccgtgggagaggtaacaacatgaggcactgacaataacgagtaaggacgggcggtggcaggatagaacagatataggtgggctagtgagaagaaccacgacaagcaaagaagggaaagagtaggatatgggactgtggacaggaatggtgagtggaagggctatagcgtggtggggcaaggccgatggagaagtaggaggaacgccggagtggaggtgaggtgtggaagtgggagggtatatacaggttgtgtgtaggtcgtctgggacgaggcggtcggggggtggcggtggaggcgaatagagagtgggggtgagaaggggagagaggtgtgggggaggagtgag

SEQ ID NO: 501 - DNA, 1225 bp, Hordeum vulgare
gaaatctaaggatgtagcagcagcaaataaagaacgactggagttcatcaaaacgactcgaaataatcctcctgcattcaaattattgcagttcttcaaggaaagcgtacgtgcctgggagtctcgaatacatagatagaatacgaccgacatagtaccaactaagcaagagtcttggaagaattgacgcgacgcacgaacagacggactgccgcgccgcacgaggtacaaaccatccaggataaaagttacaccgatacagattcccgagaggaacctacagaaatatcagttcatggcgtcggtggcctgcaccagacggagataggtaacggacggggagctctcgagacgtgtccggagcgcacgcaagagataggtacgaagatgagatgatcggaggttccggggatgttgtgccgccgtgagcaagggtgctaccatgcgccgttgaatcctcgctggacccagaaacagcacaatgatgttgcacttaggaaaggtaacgtggatcatttccttgcttgcccaacttgtgcacatcctctggtgaaagtatcttgatgtaccatacactattcacaaatgactcccaagggtcgtctccaaggagaagcacatcattctccctgtcgacgaatacaagctgccagcctgatctatcggggtcgtccaactgacccctaatgccaaacatctgacccagttcttctcgaagttcagcataattagagaaccgggtgatgtccaaggacctccccactgatcccgcctgccgaaccttcacgaatgttctgcttgttgggtcattctctcctgtattctgaaatataccagaagagtcgtccaaacaaccatacatgggactttgcagatatgttgatccagaaggaattgtcgacatgctattatccgcaacatttgaagccatgttaggcaccatgttgtacagcagggaggaagaatcaacttgaggactaaaaagggactgattttgcacatcagaaccaattttgctctcaagagaaccgtctttacttgtgggcgagctaagcaaacctgagccaccaaaagatagtgattgtgaacccataaacttttgcttccaagcctgctgctgctgctgctgctgctgttgctgctgctgatcgctagctacaggctgattgaatctagacaagtccacagctttcgaattcccctgaaggaagttcgcctcgtgccg

SEQ ID NO: 502 - DNA, 1010 bp, Hordeum vulgare
ttttaaaaacccttataatttatgtgactaagaggttccatggcgaggagaggactagctagggttggtggaccggacacatcgcgataccccgtgatgctgctgtcctggagtgctggtttagttccgggctccggtctccgtttcagtagtccagtgatggtacgaaggccatgctgccggtgagattctgcaagtcatggcccccagaataaccgtcgcagacatcgccctgcgccatcctcgctccaggtgcagaagacagaaggccttcgccgccgcggaccatccgctgcacctcctgcggcgagagtatcttgatgcaccctacgctattcacaaactcctgccatgggtcgtcgccgacgagaagaatatcattttctcggtcgacgaatacaagctgccagcctgatcttacggggtcctccagttggccttccaggccaaatagatgctccagctcactacgtaactcgtagtagctgctgaatttggtgatgtcaagcgatcttccaggggaccctgatttgcaaaccttcacaaagattccatcttgtgatgggtctacaccacacatattatcaagagagttgaaggttcccgattcgcctaaacaactcgaagttgctaaggtgtctgcgggtggcaaatcttcgccactatacctcaacaaaggtatggccatagaaaccctcccgccgctgctgccaccccttgcacctgccattccgtcctggaatgcaaatgatgatgaaagaaagtggttgtcaacatttgcaacataagcctggacactggatgagtctcttgctgactgtggcgccaaggtgccagcaaagtgggatatattactctggtgatttacattctcatgtttgggttgcacagaccgagattcaatatgaccaaggggttccacagccaacctctttgaaggccatccctccggcgccattaattggtcagttcgaggcaaactgacaaggtttgaagcatctggctagagc

SEQ ID NO: 503 - DNA, 1542 bp, Hordeum vulgare
tttttttttttttttccgcgtcttgtgtgctgcataacttaaggagcctacattcacaggattagtaaggattccatggagcatggttttggcaagttcaccaaaaccggtgggggtttacggatctcggtacaggttcctacttcttcttaacatgatatcgcatggcatgaattattagacggcagtacataacttaaagagctagtaggaatggtctatgtgcttgctctccggtaccttccgggtctcgaaacctagggggagaaagggaaaagggctgcagaaacatacgcggcgaagctatagcataaagagcgagggcttttgctctcttcagaactcgacttcgaccgagccaaccgacgcgatcccggtgctcaggctcctcgactcctgcctgctcgcatagtcgtcgcagctgctgctgccgccgccgcctagcctcttcccaggggccgagctcaggagctccaggccctgcttgcccatctgctgcacctcctgcggggacaggatctttatgcaggaaacgctgttcacgaattcctgccaagggtcgtcgccgaccaggaggacgtcctcctcccggtcgacgaatacaagctgccagcctgatctcatagggtcttccaactggccctcaaggccaaatagacgccccagttctctacgtagttcatgatagttgctaaacttggtgatatcaagcgaccttccgtaggttccagatttgtaaaccttcacaaaggttgcaggcggttgattcacttgatcaggagtgtgcgaacacggcacatatcccgattcatctaagcatcctgaactatttagagtctgatccaaggagaaatcatgttgagaagggctcagaaagttggaagtggaatagggaatcgccgtcgaatcattctcgtcgtgaagacctccttgcatcagaagtgagtgtgagtctatattgacgccgaacagaagatgattttgaggatcagagttcccatcttgatccaccaagcaccctcttccaggaagtggcgccaatgcagagctttgaggtatactaggtggcgttgtggaaagttgttccatgtgtggtgtagcctgaggccgagaaggaagcagagactccactgcaactcgctttgacgaccacgagccagcgacaggtaccgcagtaggccttgacatacttaggtgtgaagctgtttctgatgagaatggtcccaatgtattatgcatggtgggggcaccggatggggacaatgaactcattttcgtgtccgaaaagctctgaggctgcgaaaacggtaagaccgtttgcagtgctgtaggtgaagactgaggacctggggagagttgagaatatgctgactggtagtttgccatattcttctgttgttgcatatgttgatgttgagggacttgcataccctgtgattgctgctgattcgattcttgctgttggagaagctgtggcttctgctcattgaaggactgccagcgctggagctgctgttgaaggaactcggactgagcctggcc

SEQ ID NO: 504 - DNA, 920 bp, Hordeum vulgare
gccttgaggaggacaatgattgcattgcaagccttcaggatgacaatggttcgagcacgattccatattccacctgcaatttcctgagtccttctcagagtgatttccccttgaatgaagcactgactagttcaggctgcttagatgaatcaggatacataccattttcggaaaattctgatcaagtaaatcaaccgcctgcagcattcgtgaagatttacagatctggaacctttggaaggttgctggacatcactaagtttagcagctaccatgaacttcgtaacgaagtagggcgcctatttggcctcgagggccagttggaagaaagatcaggctggcagcttgtatttgttgatcgagaggatgatgtccttctagttggagatgatccgtggcaggaatttgtgaacagtgtatcttgcataaagatactttcgccgcaggaggttcagcagatgggcaagcagggcatcgacctcctgagctcggctcctgcaaggaggctcggcaacagttgtgataactacgttggcaggcaggaatcgagaagcctgagcaccgtaatcgcgtcggtgggttctgccgagttctgaagatatggcgcctgtggccctcggcttcaagtatgtttctgcagctcgtcctagtcttgtgaactggaaccaaagcacatataagatcaagtgcagcgcaaagtcgtgtcatgaatgtgatatagaccattttagtagtaagtacaacatatttggtatgcacgccgacgctttgttccgcggaataccagtgctgttaatgtagggcctctaatgttagactctttacccgttttgcctaatgtttgttttggtcatattctgtgtactactggttccacaatgtaactattgacgatgttagccgaggataagcctttatgc

SEQ ID NO: 505 - DNA, 2184 bp, Hordeum vulgare
  misc_feature (7)..(7): n is a, c, g, or t
  misc_feature (2081)..(2082): n is a, c, g, or t
  misc_feature (2100)..(2100): n is a, c, g, or t
  misc_feature (2168)..(2169): n is a, c, g, or t
  misc_feature (2177)..(2177): n is a, c, g, or t
  misc_feature (2184)..(2184): n is a, c, g, or t
gcaaccncgcgaccctcagggtcgtggtggtccacctgaataccaacagcatgactatcagggacgtggtggcccacgccctagagggggtggaatgccgcagccatcctatggcgggcataggggaggacgtggaggacacaatgttcctccaggtcagtcaagaacagttcccgagctgcaccaagcaccagatgtccaatatcaagccccggtggtttcaccatccgcatcgggagctggctcatcctctcagcccgtggcagaggtgagcagtggacaagtccggcaccaggttcagaaacttgacatcagtgatcaaagttcgacgagccaagccattcaaccggcacctgcatcaagcaaatcagttcgattcccattgcgccctggaatgggtaaatgtggggatcggtgtgtggtgaaagccaatcatttcttcgcggagctccctgataaagaccttcaccaatacgacgtgaccataacgccagaggttacatcgcgcggtgttaatcgtgctgtgattgcagaacttgtaaagctgtatagacaatctcatatgaatggacgtctgcctgcctatgatggaaggaagagcctttatacagctgggccattaccatttactacgaggacatttgaaatcgctctgcaagatgaagatgaaggcctcgttggtgggcaagccacaccaaggcgtgagagacaattcagagtggtcatcaagtatgctgcccgtgctgatctccatcatttggctatgtttctagccgggaggcaaccagatgcacctcaagaagctcttcaggtgcttgacattgtgctacgggaattgcctactgccaggtattccccagttagtagatcattttattctcccaacctagggagacgtcagagacttggggacggattggaaagttggcgtggattttaccaaagtataagacctactcagatggggctttcgctgaatattgatatgtcttctacagcatttatcgagcctctccctgtgattgagttttgttgctcagcttctgtgcagaagacatctcagttagaccgctcacttgattcagatcgggtgaagattaagaaagccctaccaggtgtaaaggtttgaggttacacatagaggaaacatgcgtagggaaagaccgtatatctggcctcacatcacaagcaacgcgagagagctatcattccctgttgatgatcgcggtactgtgaagactgtggtgcaatacttcctggagacgtatggtttcaatattcagcacaccactttaccatgcttgcaagtcggtaatcagcaaaggccaaattatctccccatggaggtttgtaaaattgttgaaggacaacgctactcaaaacgactgaatgaaaaacaaataactgctctactgaaagtgacttgccagcgccctcaagagcgtgagaaggacatcttgcagactgtgcatcacaatgcgtactacgaagatccatatgcacaggaatttggcataaaaattgatgagcaacttgcatcggttgaagctcgtgttctgcctccgccaaggcttaagtaccatgatagtggcagagagaaggatgtcttacccagggtcggccagtggaacatgatgaacaagaaaatggtcaatggtggtagagtcagccactgggcatgtattaacttctctcggaatgtgcaagataatgctgccaaggttttctgtcatgagttggctataatgtgccaaatatctggaatgaactttgcacctgaacctgtgctgcccgtacttagtgcgaggcctgaacacgtggaaagagctctgaaggcacgttatcatgatgccatgaacgcaagcaatcccccatgcaaagaacttgacctgctaattgttatactgccggatgattatggttctctttatggggatcttaaaaggatttgtgagactgaagctaggattcgtatcccagtgttgtcttacagcgcatgcgtttgagatgagcacgccgcatcttgcaaatgtaactcttaacatcgatgttaaagacacggagaagtatactcgacctgnngaatatttcagcaaatangatgcgcctctaatctgaccgaggcgacgatatatttggcgatagtggatggaatggctagtcgcggnnagaacggnacccggn

SEQ ID NO: 506 - DNA, 969 bp, Hordeum vulgare
cggcacgagggggagcagcgccagcagcaccagcgatagtgggggggagctcggacgaggcctagggtttccggagcccgcctcctcctgcgccgccgttcgccgagcttgttcagcagcggccatcatggttaggaagaaaagaactggtcctggcagccctggtgagagttctggggaagcttcgggagcttctggacagggttcctcgcagcgagctgagagagctcctcaacagcatggtggaggacgtggtttggcaccgcaacacggtagccgtggtggggggcaacatcagggccgtggtgggcactatcaggggtatggaggatcagcttcacaccatccaggtggtggcccacctgaatatcaacagcgtgactatcaggggcgtggacatcccggtggcggtccacctgaatatcaacatcgtgactatcaggggcgtggacatccggggggtggcccacctgaatatcaaccacgtgactatcagggacgtggtggtgcacgccccagaggtggtggagtgccgcagccatactatggtgggcataggggaggtagtgctggacgtaatgttcctccaggtcaatcaagaacagttcccgagctgcaccaagccccccatgtccaatatcaagccccgatggtttcaccatctgcatcgggagctggctcatcctctcagtctgtggcagaggtgagcagtggacaagttcaccaacagtttcagaattctgcgatcgtccatcaaagttcaacaagccaagccagcccactggcaccagcatcaaagcaaatcagttagatttccgttgcccccttgaaaaggtacacatggggaatggggttgttggaaaggcaaaccatatcttggctaagcctcctgataaagaccctcaccaataccaatgtcttcataactccacaaattacatcactggggtcaatccggttggatggccg

SEQ ID NO: 507 - DNA, 1270 bp, Hordeum vulgare
acattcacattcactacatcataccacctcttcagtttcctaagcccttaaccacccaccttcacttttacatattccttttcctccttcaatttcgtccaacttgcttatcctaacgtcctctcctccaaatacctgcctcgccgctccattcgctgtgtctctcttccaccactcactccgtctcccccttgtgtctcctccaacaccttcctagaatccatattaattgtagcttaaatgcttcttttctctccctcagccctctattggtatccttgtccctcctttcaattttttttcttgtttatattattttttctatttttctcttttctttcttattatcatccttaatgttctccaatactaagtcctgcttcacacttaccagtccgccagccccgcgtcccacgtcactaaatttcagaccatacctacccatccgtatacatgttctaccggaccaagttcagaccatatgaagcagtctgtatatatgttctaccggccaagacgctaagcgggcaccggtgagaagccggcatcagatgaagaacatgttgtcctgaagatccacgtgcagcgtcgggaagttgctgaagtcacaagcccccgccgctgtggaggaggccgacgacgacgagctgcgcacctggggctgggacgccagcatgccctcatagtagagcctgccgcggtacgccgccaggtcggcgtagtagacgggcgtcgccagcgacacgggcttggtgcagcgcgcgaacacgaagcagaggttgtacaccagcctctgcaggtcgtctgacccgtagccatgctcgtccatcaggttgtagtagtgcgtcggccggctggtcccaatcagcccgttgtggctgcacaggtagaagtcgtacgtcacggggtcaacaattctggtgtccaccaccgtgccagggagcacattgccgttcttcgtctgcagcggctcattgtgctccttggggaacagccgcgtgtggtgccgcttcttggccacaataacggtaatcgttggagagtagcccttcaccttgatcacgttctccatgtccgcaagctcctcgttaaggaccatctcgaactgcccatcactcacgccatcacggaagtaaatgatcctctgaggctttacgccggccttcttctcaaagacaccaataagctcttggacaatctcaccgaggttcttgatcacctcacagcggtgtggctgggcacggattctaggcacatacttgcctcgtgc

SEQ ID NO: 508 - DNA, 1120 bp, Hordeum vulgare
tttcctccagttactactctgatcagcagtacggcctactttcttcttatgcaatgagatcagcgtatagcgggcgtatgcttataccactgaatatgcctgctgatgcaccggtttatgtgaacgccaagcaatatgaaggcatccttcgtcgccgtcgtgctcgcgctaaggcagagaaggagaacaggctggtcaaggccagaaagccatatcttcacgagtcacgccatcttcatgcaatgcgccgtgcgagaggctctggtggacgcttcctcaacactaagaaagagaccaatggaaaagacactggtgttgggagcacggcgatgggtggtaaccagtttatgcgcccaactgcatctctcagttcagagatccagcactctgagcagggaaacccaagcagtgtctccagcctgtctggctcagaggtgacaagcttgtatgatcatgaagatgtggaccactaccacaactttgagcacctccgcacacacttcttcaccccgctcccgagcatcatggacggtgagcatggggccggcaaccccttcaagtgggcagcagcctccgatggctgctgcaacctcctcaaagcatgacttgagggggtaccggacagctgaaatatcaagagatggcgcaaaccggcagcatctgccggcattgtgtctagctccaggtcagggatcgtccctgccgtcatctggctgtccgtgggcaattcattcttggctcatggcatcggtagtgctttcgctcatcgcctacttgtcctcggaacttgagtgctagtttccaggatcctgtggtgagtgaaacaccccctttgccataaaaaatatattatctaggtaagtacaactgcctgctaccatcatccggccctttcgcggtagcaggtttaaagtttctgtttgaataaaatgtctgaaacttcagactagttggaatggtactggaatcggagttcgtatgaagtattggtatggcgtttgtttggagaagtattgaagtatgttaagtaaacttggtgatgtgttgtaatagttggcttgaaggttctgtgtgtagacttggtttgtttgcactctctggtgttgacacctaaattcag

SEQ ID NO: 509 - DNA, 1392 bp, Hordeum vulgare
cacgaggggacagcttgaactgaaagcaagagtagaagcccatgagatgagacgcaagcaaaatatgcatggtattgttcgattctaatgtggcagttccactctcctactcgactgcatatgtgatgtatatactgatttcctgctactgttagagttataccgacatcttttgtgttcctctgacagaaaatggcacaatcatgattcagtttggtcagcaagtgcctaattacgagtcatcagctagcgattctcctcgagaagtgtccggaatgagcgaaggaagctttaatgagcagaatgatcaatctggttcgcccttgactcaccgaactatgccttctctgaattattacatagtcctgtaataccatctctcctgaaaataaagaattgaacattctccatttgtttcctcttcgtactaatactaggtaatcgtgatggttacacgaagagtgatgaaggcaagatgatgtcggctttatctctgggcaattcagaaacagcgtacacaccgccaaaacctgaccgcactcatcccttcgccatatcatacccatatgctgatccttactatggtggtgcggtggcagcttatggcacgcatgctattatgcacccccagatggtgggtatggtaccatcctctcgagtgccactaccaattgaaccagctgctgccgaagagcccatctatgtaaatgcgaagcaataccatgccattctccgaaggagacagctccgcgcaaaattagaggctgaaaataagcttgtcaaaagtcgcaagccgtacctccatgagtccaggcatcagcacgcgatgaagcgggctcgggggacaggcgggcggttcctcaacgcgaaggagaagtccgaggcggcttccggcggcggcaatgcatcgggcgaggtctgggcatgccagcgttcctgcggacggcggcatgttctcgaagcacgaccacaccttaccgtccggtgacttccattaccgcgcgagagggggcgcctagggcggcgccgttgccccctggcaaatcatccttggcttatgtgtgtggcgaccgtcaactcggtcgaatgataatactgtagtaaactgaaagatttggggattgaaactgttacttggggtgtttggtagacagtctgttccgtttggggacgaagcgggccagtctctctgttgggggttgattcatggcacgggatgtgctgctaagctggagccctgcttagaactgtttttcctgtcacttttatggggtaataagggacctgatgtttgatactgggagcactcctgagtcggcgtcaattaccattcgccggcgttgatcctttgcgcacgtggggggtgtgtttatttagaactagaaaaaaaaa

SEQ ID NO: 510 - DNA, 899 bp, Hordeum vulgare
  misc_feature (16)..(16): n is a, c, g, or t
ctttgatgaagagaancaacatgctgcatcccggatgcctgctttggcgtcggactatttaccaccatactcacagctggaactaagccagccaatggcttcggcaccgtacccgtaccctgatgcttactacgcaggcatggttggcccctatggcgctcaagcagtggctcacttccagctaccggggctgacccactcgcgcatgccgctgcctctggaagtgtcggaggagccggtgtacgtgaacgcgaagcagtaccatggcatcttgagacggaggcagtcgcgcgccaaggccgagctcgagaggaaggcgatcaaggccaggaagccttacctccacgagtcccggcaccagcacgcgatgcggcgggcgaggggcaccggcggccgcttcctcaacacgaagaaggacgagcacggcggcggcggagccgaggcgggcaaaggcgagcagagcgcctccgactacctccgggtggtgccgccggacctgcatctccgtcaggcgtgaagtggcagcaccttgatgcaacctagaacagcggctcctcctggccgccggccgtcgtgccacgtcgccacggcgtgggggctggtcggggattcagggcctgctgctgtgtccaggcaattcattcttggctttcgcgttctgttatcacccctcttgtgttggatgtgtgcgagtggagaagaactagcaggctgtgcgcgtgtgagattgattgtcagactcgggatggatggcgtgtgtttgtatactgcggtagagtgggatttggcttgattttgataattgggtactgcacagaaaaaaaaaaggtgtcagcgttcgtcagtgtcgcgtgcttctcgtgcagaagcaggaagactgtctcgaaactttcggattt

SEQ ID NO: 511 - DNA, 446 bp, Hordeum vulgare
cggcacgaggctccgttccagatgacctctacctcacccgaaaccacctaggaccgtcggcggcggcaacctttcccctgctacacggtgcgcttccgttccagctccagccttcctcgccaccgcttcgcggggcgatgaagacgacggctgccgaggcagcgcatcagcagctgctggacgagctggctgcggcggcaaaggcagccgaggccggtaattccactggcgcgcgtgagatattggcgcggctcaatcaccagcttcccccccttgggaagcccttcctccggtcggcctcctacctcagggaggccctcctcctcgcgctcgctgatggacaccacggcgccccccgcatcacctcaccgctcgacgtcgccctcaagctggcggcttacaagtccttctccgacctgtcgcccatgctgcagttcgctaacttc

SEQ ID NO: 512 - DNA, 1068 bp, Hordeum vulgare
ttttttttttggtatcggtactgctgaatttcagtgacaagtttgtctacaacaatggtatgaatccatctcagatggtgagatgagctgaggttagtatctgacagcgagaattatgggaccattgcgccgatgcagagagcgcaaaaaagaagggacatttcacttgggcagcatgggaaatacagtcatgaatccaatccactacatgaaaccgccccggcgcaagaccgaaaacgctgaaacgccggaggagcaaaaaagatactggcttcccagaacatttacagtatggcttctttttcagcgggggtggtggtggtggtgttggttgcttgacgacgatgatggagccatcgggtcgaaccggaatgaggccgatggggcggcgggggcagctgccgcggctgttttggagaatcctgatgatgctgcagcggacgatgacgacgagaagagtggcatgggttgtgttggaggagggtggctcaccctccatgcccaggttggaacaccccctgtggccacctctggcctcctgctatgatctctggctgcatcctcattatttaagaagaggggatatgattggccatgccagattggtggatgctcggtcagaacggggtaccgatgagggattgcgaccatctcagggggggcatcgacctttggtctctttagttcagagccttcatatgatccatggtggagctgcaggccaagggtgctcttatcccttttgggactttgtgaagttggttgagatatgctcaagttgaggtcgacatcagcgccttcagcagcagcttcattgagcagctccgcatcataggtgctcggctcgaagttcgtcacggcctctctaccattgcatttgatcgccgccttgtcgtaagccttcttgccgaggaactggcccatgcgcgcctcccaccggccgcacttgtgcagggtgacgcctctgtacttggagctgccccgcgagaagccggtgctctgccgccgcagcacgtgcacgaactcctccttggacaggcccttcatctgcttcatgtcgcctcgtgc

SEQ ID NO: 513 - DNA, 1815 bp, Hordeum vulgare
ggcgcagggccctctcctcgtcctcctccagtcctcatccccatggccaccaccaccgcctccaccccccaccactacttctactcctcccgcctcgccctcgcagcccgcggccaccgcgctcccatgccatagacgccacccagctgatcggtcgacctcgctcggacgcggcacggcgagcgaggcgggcatacctgcgtttcatttgcgagttcccggcgcgcgggcctcggatcggaggacggagatggtgctggatctcaatgtcgagtctccggccgactccggcacgtccagctcgtccgtgctcaactccgcggacgccgccggcgccttccggttcggcctgctcgggagccccgatgacgacgactgctccggcgagctggcgccggccgccgcgtccgggttcgtgacgaggcagctgttccccgcgccgccgcccgcgcccggggtcatgatggggcaggcgccggcgcctccgcccacggcgccggtgtggcaacctcggcgcgccgaggagctggtcgtggcgcagcgggtggcccccaagaagaagacgcggcgggggccgaggtcgcgcagctcgcagtaccggggcgtcaccttctaccgcaggaccggccgctgggagtcgcacatctgggattgcgggaagcaggtctacttgggtggtttcgacaccgcgcacgcggccgcaagggcctacgatcgcgcggcgatcaagttccgggggctggaggccgacatcaacttcaatctgagcgactacgaggaggatttgaagcagatgaggaactggaccaaggaggagttcgtgcatatcctccgccgccagagcaccgggttcgccagggggagctcgaagtaccgcggcgtcacgctccacaagtgcggccgctgggaggcaaggatgggccaactgctcggcaagaagtacatatatcttgggctgttcgacagcgaagttgaagctgcaagagcgtacgacagggcggcgattcgcttcaatgggagagatgctgtgactaactttgatagtagctcctacaatggagatgctacacctgacgtcgaaaatgaggcaattgttgatgctgatgctcttgacttggatctaaggatgtcgcaacctaccgcgcacgatcccaagagggacaacatcatcgccggccttcagttaacttttgattcccctgagtcgtcaaccacaatggtctcctctcagccaatgagctcatcgtcccagtggcctgtgcatcaacatggcacagcagtaccacctcagcagcaccagcgtttgtacccatctgcttgtcatggcttctaccccaacgtacaggtgcaggtgcaggagaggcccttggagccaaggccccctgagccgtcctccttccccggctgggggtggcacgcgcaggccgtgccgccgggctcctcccactcgccgttgctttatgctgcagcatcatcaggattctctaccgccgccggcgcgaaccccgccccgcccgccgtcgtaccccgaccatcaccaccgcttctactcccccgcccgccggacaactagctctctgcttactcccatggacggtggtcgacgggtgtgggcgtgtgcgcgggcgcgatcgacgtgttcgcgccttgtcggtaacagttgttgtgaattaatcggagagagataacattgccgagccatgtgtcactggctggttcctctccctcgccatgatcagaatcacaggcatcatggtttcccgttcagactacgtatccatgctttcaatcatgatcatgatcatgcggttgtcc

SEQ ID NO: 514 - DNA, 545 bp, Hordeum vulgare
  misc_feature (14)..(14): n is a, c, g, or t
ttcggcacgaggcncgggagacgactcggccacccgcgccccctcggcgcaggccgcttccttcaccgagctgctcactggattggcggccgctaccccagccgctgctcagcacaagcaccacaactcgtggcaccagatgaccgcgtctgccaccgcggactacctcggcttcgcccagccccggaaatccgggcacgggatgctgcacaccttcgcctccccggccccgcaccttggcaacattgcgcccgtcgccatggccccggggcagcacttcagcttatcagctggcggcgagccgcagacggagatgccgcacttctccttctcgcaagaccactacatgcccgtccatgcggcggcaacgtcggctccgtcagtagactacaatctcaacttctccatgtcctcgggtcttgtgggtgtcaacaacaccagggggacccttcagtccaattcgcagccgcacctctccggccaccaccagcagcagcagctccagaggctgtctactccactggatgctccgcacatacccttct

SEQ ID NO: 515 - DNA, 937 bp, Hordeum vulgare
gaaatatggaaagatgatgctgtgaccaaaaaggatggaaagataaagaaagatggagtgatagactcctctccctatccatcacccatttataagtttgacaacaacatctagtagtaacatgcatacagcaacaagtgaaagaaagaacgcaatcgagctttgacctacagcaaactacaacatcaactacacctaatgcaacgcaacagagaggctggctggctgaccagatagctatgtcgctgcacttctcacaagcctaattctaagaagctccgagtgatcttgaagcaaaagccaatgacacacgcagcagaagagatggaaaaccaaccaaccaaccaaccagccagacgtagaaccagttcctgattttgctcctcctagttgcaatcgatcgccagctcctgtgaagaagcggcatcgaattagcttttcgcaccagtgatgcaagtggaggagctgatggcggatgtcgttactggtacgctgtggaggttggtggtgaagtcatctgtcgtccactgctgctgctgtcagtggcgggaagccgaggaaacggacggcggcttgtcgccattgccgccgctgtgctcctcgttgccctgcatcctcgcggggacgcggaacccggagaagctgacgccgggcccgaacccgatggccgacacggaagggttcaagcccccttggtggtgctgctgctgcatcgggttgttgtcgtcagcttcgacggtctccggccatcctcggtcggagggctggttactggactgaaggggtcccctctggaagaagaactggctctggccactcagcgccgcctgcatatgcgccgcctgctgcgacacgttgaacaggtagccgccggtgctcccgccgcctgggtcgggcacgttccacggcatcatgcgcggctcggcgcctgctcggc

SEQ ID NO: 516 - DNA, 657 bp, Hordeum vulgare
gcacgagggacagatctcgtgttcaaatcaatcggtgcaaacggtaaccgtctagagatgctgtcaatcgcctttgctgggaacagtgatcttggccttcattatatcctctctggctgcaagagcttgaagaagctggagataagggactgcccatttggaaataagccgttgctggcaaatgctgccaagctggagacaatgcgatccctttggatgtcgtcgtgctcattgaccctgggcgcatgccgacagcttgcagagaagatgcctcgccttaccgtggagataatgaacgatcctggacgaacatgccctgtggagtcacttccggatgatagcccggtcgagacattgtatgtgtaccggacaattgccggtccaaggtccgacacaccagattacgtccagattgtttaaaggtacagcggtgtattcattttcaacctggattggattggtaccttcaacaccttcctagcataacatagaattttcctgtcaagtagaaaggctggtggttggataaagctgtcataaaatctcgactgggtggattacagaaactgctagatagcgtcatgagaaaacgtcggtttgttttctttagcgtgtttagttcttttatgtataaagatatggcaccattttaatctt

SEQ ID NO: 517 - DNA, 501 bp, Hordeum vulgare
cggcacgagggctgtccaaaactgagctcattgctatatttttgtcaccaaatgaccaacgccgcactgcatactatagctaagaactgccctaatttcacgcgattcagactctgtattcttgagcctgggaagcctgatgccatgacaaaccaaccattagatgaaggttttggtgccattgttcgtgaatgcaaagggctaagacgattgtcaatatcaggtcttctcaccgacaaggttttcatgtatattggtaaatttgcaaaacaacttgagatgctttcaattgcatttgctggagatagtgatgcgggaatgatgcatgttatggaaggatgcaataatctgaggaagctggagattagagatagcccatttggtgatgctgcactcttggagaatgttaccaagtatgagacaatgcgatccctttggatgtcatcgtgcaacgtcacagaaaaggggtgccaaattcttgcatcaaagatgccaatgctt

SEQ ID NO: 518 - DNA, 1383 bp, Hordeum vulgare
aacagaacatatgcggagcatcgataaaactccagccattattattaatacagtatgctcagttctggggagatgacccaagatgtagtacaaatattacatgctgaacaagacagaataacggaacaaatagaagttttaagacccaacagatgtctgctctttcgaccttttgatcacatcaaccttaccggattcagctcaaccgatcagttgcaattgcaccgacacaaattcccgcaggtgacagaactgacagtaacaacagaacggtccgattgcttcagtaagtaacgaaaacaaccgctttggcattgaatttgtacacaacagataaccttctcgccaagtcacaacgacacagaaacgtataacaaaatgaaatgacaacgtcaacctttgctaagaaccggtcagggcgaggcagaggggcacggaccgaatgccgcgccacatgctatccactgctttttgcggctgcaagggagcatgcaatcaggtaccttctgccactccttgctcacaaggttgtacatcacgaggcggttcattcgcttcgccttcaaggagagcatgagcaagccgctgttgcccaggcaggtcatcctcatgtgcttaccgtagaattctaagcaccagatatttggcattctgtccacctccttccagaggagagtcatcttctgcaactcccagatgcagacgcaggtcgctgcgttcttgcacagcaggcccacaagcatgatcttcccctggaactcggcaagtgtgtggtcagtcagatgcagcggcagcgggatgatgaaatgaatccaagtcccggtgcttacatcatatgacaacacaccctcgggttctgagcacatgaagtacagtgtgctgccaaccgcgactggctgtgacctgaaatttagagcaagtgggagcttgatgcttggaggaaactcgcctggctgaaaccacatattctgcagagagtcgtagacctcatgatttccatcatttcgcaaccacatcactttgtaaccctcattaggagctcttccattcagcaccatccctactgacactcttgaccatgcctgaactgacctgggaggaatttcctttagtgattgtgtaagagggttgcatatgtagaagttcctgtggctaagatccaataagcaaacaaggccacctgcagatgccactggcattactatgtttgcaggagcaaggggaacagaagggtggtgccatttgtttagcgaagggtcatacatcgctacattgttgttgccattctcatgtgtgattgtatagaaccatggcattccatgtggaacttcagagtactgctgagagaaattgtctgagcctaccatagaacaccacttccgc

SEQ ID NO: 519 - DNA, 1186 bp, Hordeum vulgare
aggccgatcgagccctgcgcagcgaggggaaagagacacacacagcgccaccaggcaagtagtagtaaaaggcaaaagcacggcacattaaaagagaggccagcccagccccggaccggaccggagccaagcagcagccgcagccgcagccgcagcagaggagagagagagggagggagaagcatatatggcgatgccctttgcctccctgtcgccggcagccgaccaccaccgctcctcccccatcttccccttctgccgctcctcccctctctactcggtaggggaggaggcggcgcatcagcatcctcatcctcagcagcagcagcagcagcacgcgatgagcggcgcgcggtgggcggcgaggccggcgcccttcacggcggcgcagtacgaggagctggagcagcaggcgctcatctacaagtacctcgtcgccggcgtccccgtcccgcaggacctcctcctccccatccgccgcggcttcgagaccctcgcctcgcgcttctaccaccaccacgcccttgggtacgggtcctacttcgggaagaagctggatccggagccggggcggtgccggcggacggacggcaagaagtggcggtgctccaaggaggccgctcaggactccaagtactgcgagcgccacatgcaccgcggccgcaaccgttcaagaaagcctgtggaaacgcagctcgtcgccagctcccactcccagtcccagcagcacgccaccgccgccttccacaaccactcgccgtatccggcgatcgccactggcggtggctccttcgccctggggtctgctcagctgcacatggacactgctgcgccttacgcgacgaccgccggtgctgccggaaacaaagatttcaggtattctgcctatggagtgaggacgtcggcgatcgaggagcacaaccagttcatcaccgcggccatggacaccgccatggacaactactcgtggcgcctgatgccgtcccaggcctcggcattctcgctctccagctaccccatgctgggcacgctgagcgacctggaccagagcgcgatctgctcgctggccaagactgagagggagccactgtccttcttcggcggcggcggcgacttcgacgacgactcggctgcggtgaagcaggagaaccagacgctgcggcccttcttcgacgagtggcccaag

SEQ ID NO: 520 - DNA, 640 bp, Hordeum vulgare
cctgcctctatctacctcgagcttaaagcccagcacgatctgcctcgccgagtcagtgtgagcgagctcttgccgtagtagtagtaacactcgcgctgcgctgtggttggtgcggccggagcccggagagacagagagagatagagatgatgctgggagggcaaggcggcggtgggaggtgcctgttcacggcgtcgcagtggcgggagctggagcaccaggcgctcatctacaagtacatggccgccggctcgcaggtgccccacgagctggtcgtcccgctccgccaccgcgacgccgccttcgcctccatcgacaccgccccctccctcgcctgcttccctccaccgcagccatccctggggtgggggctctacgggaccggggcgcagtacgcgcggaagccggaggacccggagcctgggcggtgccggcggacggacggcaagaagtggcggtgctccagggaggcgtacggggagtccaagtactgcgacaggcacatgcaccgcggcaagaaccgttcaagaaagcctgtggaaccaatgtcctcctcctcctcctccgtctcctccccggcggcctcctaccgccagaccaccctctccatgtcgccccccacgccggccgacgcgcccag

SEQ ID NO: 521 - DNA, 1413 bp, Hordeum vulgare
aactccaactaaaccaactaatacatagatttttttttcaatgctcatatagattctgcaggtctctacgcgatttgatgtaacgggtcaacaaaacagacaattgaaatcaacaatacaccacaacagaagctgaaggactcgaacacataataaagaaagaaaatacaaaaaatatataccaataaacactagacatgaacatagttttagttatttgtgattccacaagaccagccggaacacttgaaaagagagctgggcctccgaggttgtgcgttctaccggcaccccatgagataggaattattagtgctgtgattctctggtacaggacccactttttagtgttgctgctggacacgagacttaggattccagttggaggatctaacttgggctctcgatccattttgtcagttaagatgttccataagctgactggcaactcttgcttctgaaaacctcacctagaggtccatcgtcaagtgtttccctagttactggcgaccaagtttcctgcaacctataacctttttctgatgaactgcccgctccatgtgtaatgtaagactggtcaagatcatgatgcaacttcagtggtaaaaatgctactttgtcacaatttgaagaagaatgtgatgacgagaaatcaaaggaatgcattgtagtggataccaatgattgctcgactacactctgcttctccagtggttccctattggactgtcttgggaaaggatcagtcacattagcagctaagcttttcacctgctgctgccaagccacggcctggcagtgtgatgaaaaaccaccagaaacagccctcgtccgttcggcaacggtggttgtctctttcggccttccacatgctttcttgaacgttggcgaccatggtttatgtgtcgctcacagtacttttggtccccaacagaatctgtggagcaccgccacttcttgccgtctgtgcggcgacatcttcggggttccccatcagcaccgctggaacgaaatggtgcccatcctgcccatggattgaggctcctcctgatggggaggagccaactggatggcacaggggcctttgcagctatgtgcttgtagataagggcctggtgctcaagctccatccactgagttggggtaaatggccccctaacccttgccaaaaaaccctgcatgcttgtccctgagctcaaacccaaccccgctacatcattggagaagctcagcatctgcgccctcggaaagccggtggttccaagaaaggaacaagatgaaggtggtgctggcgaagcccctgccgtctccaagaacccatctggggcctcttgctcctcgcatctgccatgcttctgtggcgagcccggatggccgccgccgccgccagcgcaggagctcagcatcgtcgtt

SEQ ID NO: 522 - DNA, 899 bp, Hordeum vulgare
ggtcaaggaaaaattaaaaattactccagcataatcctcggagatttcccgctacagatcaacacaaccaaccaagcaagcaaaacatctgcagctaactgaaggaacacgccggcatcaggtcaggtggcacgggcggtgccgtgggccaggtagacgccggcgggggaggagaagctgagacgctgcggcggcgcgtgcgcgtgcgcgccggtggcgccctgcccgtcggcgacgtgcattgcgcggatcggggtggctgaggtggccgccgcggcttccacaggctttcttgaacggccgcggccgcggtggacgtggcgctcgcagtacttgtgccccggcaccacgccgtgcgagcaccgccacttcttgccgtccgtgcgccggcacctgtccggctccggctccatgctgctcctctggtcgtagcacatgctccccagccccgccagtgatgggaacctctgaggagcggaggaggaggcggcgaggctcttccagatggggaggacgaggtgcacgggcacgggagcgttggcggcgaagtagcggtagatgagcacctggtgctccagctcctgccgctgcatgaacgtcagcgccgacggccgcgtggcctccgcgtcgctgcgcctgctgtcactgcagcagccgcccacgccgaggcccagcccaagagccagcggcaacggcgcggccatggtcaccgtgcctacgccgtcgttggcgtcggcgtcgtcatcggcgccggagaggcgggggagcttggacggcggcgagtgttcctcctgccttcgctcggtcatctctggagtgtgcccttcacccgtggctgtctgagtgtctggtgcgtgctgtgcgtgctgtttttgcgtttgaacgcttgcctcgtgccg

SEQ ID NO: 523 - DNA, 271 bp, Hordeum vulgare
  misc_feature (166)..(166): n is a, c, g, or t
  misc_feature (172)..(172): n is a, c, g, or t
gcgtgaattgttcctgcgcaagaaggtggatccaaaaccggtgcggtgccggcgcacggacggcaagaagtggcggtgcgacaaggaggccttctccgactccaagcattgcgagaaccacatgcaccgcggccgcaaccgttcaagaaagcctgtggaaacgcanctggtnccccactcccagccgccgccggccgcctccgccgtgccgcccctcgccaccggctgccagagccactctctctaccccgccatcggtggtggtggaggc

SEQ ID NO: 524 - DNA, 1618 bp, Hordeum vulgare
  misc_feature (1240)..(1240): n is a, c, g, or t
  misc_feature (1348)..(1348): n is a, c, g, or t
  misc_feature (1462)..(1462): n is a, c, g, or t
  misc_feature (1569)..(1569): n is a, c, g, or t
ctgcctgggggcaagcatctgccttgcagaccgatcaaagtgttgggacaatgggggcacacttgctggtgctgctcggcaccttgctgttgctcccacagctgctgctcgccgggacgacgagatactacaccttcaatgtgacaatgcataacgggacacgggtatgcaccacccccgccatcccgacggatgaacgggccaagttccccccccccccgaaatcctcacaagggaaggcgaccgtgtcgtcgtcaaggtggttaacaatgtgaagcacaacgttaccatccactggtaaatctttggccccttgctcttacttaattccatgggcgataatcgtactgctagctacattttcataaacaaagccatgctcaattgctcatcacaattgaagccagttttctgaacaccggtcggttctatctttcggcaaaaaattactctctctgtaccgtgctgtatttgtatggataactggcggtgatgtgatgtgagcgcacgcacggggtgaggcagctgccgacggggtggtccgacccgccggcgtacatcacccagtgcccgatccagacggggcggagctccgtgtacaacttccccgggaccgggcagaggggcaccctgttctggcacgcccacgtctcctggatgcgcgccacgctgtacggccccatcgtcatcctccccaagctcggcgtgccgttcccgttcccaaaaccctacagagacgtccccgtcgtcttcggcgaatggtttaacgcggatccagaggctatcatcgcacaggcgctgcagactggtggaggcccaaacgtctccgaggcctacaccatcaacggccttccaggcccactctacaactgctcgagcaaagacacgttcaagctgaaggtgcagccaggcatgtggtacctgctccggctgatcaacgctgcgctcaacgatgagcttttcttctcgatcgccaaccacacgctcaccgtcgtcgacgtcgacgccgcctacgtgaagccgttcgacacggacgtggtcctggtcacgccggggcagaccaccaacgtgctcctcctagccaaaccggacgacggctccccggccgccacgcacctcatgctagcgcgcccctacgccacgggacgtgttggcacctacgacaacaccaccgtggccgccatcctcgagtacgcgccggcggggcacatcaagaaccgtccgctcctatggccgacgnctaccgtgttcaacgacacggcgttcgccgccaactacagcgccaggctccggagcctcgccaccccggactaccctgccagagtgccgatgcgggtagacaggcccnttcttcttcaccgtggggctcggcaccaccccgtgcccgacgtaccaaggtgcaacggccctaccaacgacaccaagttctcgcggtcatgaacaacgtgtccttcaacatgcncacgacggcgctcctgaggcgcactacgacggcaacacagcccgcgtgtacacgtcagactttccccgccacgccgtcggagccgttcaacttacaccgcacgccgncaaacaacacgaacgttgtcaacgggaccaaggagctttgctgccctca

SEQ ID NO: 525 - DNA, 673 bp, Hordeum vulgare
  misc_feature (551)..(551): n is a, c, g, or t
gcctacaccatcaacggccttccaggcccactctacaactgctcgagcaaaggtacgtaacccacaacaagaggcccaattcctcccatcatcatcatcaacactcaaaaaaaaaaaagggtttcggttttcatgtcgatttatttttagctgatggaatgaacatttgcagacacgttcaagctgaaggtgcagccaggcatgtggtacctgctccggctgatcaacgctgcgctcaacgatgagcttttcttctcgatcgccaaccacacgctcaccgtcgtcgacgtcgacgccgcctacgtgaagccgttcgacacggacgtggtcctggtcacgccggggcagaccaccaacgtgctccttcttaccaaaccgggagaagggttcccgggccgcacgcaccttatgctaacgcgcccctacgccaccggacctgttggcacctacgacaacaccaccgtgggcgccattctcgagtcgcgcccgcggggcacattaaggacccgttcgctcctatgggcgacgctacccgtgtttaacgacacagnggtttgccggcaactacagaggcaaggctccggagactctcccaccccggactacccctgccacagtgccccatgcgggttaaacaggcccttcttttttaacgtggggggtctgcacccac

SEQ ID NO: 526 - DNA, 1070 bp, Hordeum vulgare
ctgccaccggctccggtctatttaagctagccggccctcggttcgcgagtcttctgcccagcatcgtgcatcccctcccctccccaagtcagtcataaacccaagtcggactcgccttcctcctcctccccaaccactccgctcttccgccgcgccatcgcaccggggggtcacctgagatcacatacacaatggtgaaggctgtagctgtgcttaccggcagcgagggtgtcaagggcaccatcttcttcacccaggagggagatggcccaaccaccgtgacgggaagtgtcaccggactcaaggaagggcttcacggcttccatgtgcacgctcttggtgacaccaccaacggctgcatgtcaactggaccgcacttcaaccccgctggtcatgtgcatggggcacccgaagatgaaatccgccatgctggtgacctcggaaatgtgacagctggagcggatggtgttgctaacatcaatgttactgactgccatatcccccttgctggaccacattcaatcattggccgtgctgttgtcgtccatggtgatgctgatgatcttggcaagggtggacatgagcttagcaagagcactggaaacgctggggcgccgcgttgcttgcgggatcatcgggctccagggctaagatgccgtcttcgcaggctgatgaacgccgtacagatcttggcacttgaaggacaccgacttgcaattgctatctattttaaataagcacaccatctatgatcgctttttagtgtgcatcatttgtgtcgattcctatgtgaaactttcatatcactgtcatttggctttttgagttgcgtgactggaacagttcagttctgtcaagtgcttgtggatgtgctgttgttcttaatgccgttaccagctctgggcatattcagcgaacgagagagatttcaggtttcattatttatccttgtgaagcttatagaaagccattaaacttcactggccggcgtttcaaccggcggactggagaacctggtggttcccattaatcgcctgtggacaatcccctcttgccagggggggagaacg

SEQ ID NO: 527 - DNA, 881 bp, Hordeum vulgare
ccatccccaagtcagtcataaacccaagtcggactcgccttcctcctcctccccaaccactccgctcttccgccgcgcatcgcaccggggggtcacctgagatcacatacacaatggtgaaggctgtagctgtgcttaccggcagcgagggtgtcaagggcaccatcttcttcacccaggagggagatggcccgaccactgtgacgggaagtgtcacgggactcaaggaagggctccacggcttccatgtgcacgctcttggtgacaccaccaacggctgcatgtcaactggaccgcacttcaaccccgctggtcatgtgcatggggcacccgaagatgaaatccgccatgctggtgacctcggaaatgtgacagctggagcggatggtgttgctaacatcaatgttactgactgccatatcccccttgctggaccacattcaatcattggccgtgctgttgtcgtccatggtgatgctgatgatcttggcaagggtggacatgagcttagcaagagcactggaaacgctggggcgcgtgttgcttgcgggatcatcgggctccagggctaagatgccgtcttcgcaggccgttgaacgccgtacagatcttggcacttgaaggacaccgacttgcaattgctatctattttaaataagcacaccatctatgatcgctttttagtgtgcatcatttgtgtcgattcctatgtgctgctactctgaactttcatatcactgtcatttggctttttgagttgcgtgactggaacagttctgtcaagtgcttgtggatgtgctgttgttcttaatgccgttaccagctctgggcatattcagcgaacgagagagatttcaggtttcattaaaaaaaaaaaaaaa

SEQ ID NO: 528 - DNA, 818 bp, Hordeum vulgare
cggcccgcaccgcactctaacatttctcctcgtcctcgtacttgctagctccggagtgagtgtttgatcggtaggagctcctgaggtaattactagcaatggcgacgcagggaagaggcagtgcagccgtggttgtgggcgtgctgctcgtctgcgtgctcctgaacgcagcggtggcggatgcggcggtgttcaacgtcggcgaccgcggcggctggtccttcaacaccaactcctggcccgccggcaagcgcttcaaggccggcgacgtcctagtgttcaagtacgacgcgacggcgcacgacgtggtggcggtgagcgcggcagggtacaaggcctgcgccaagccggccaagggcgccaaggtctacaagtccggcgccgaccgcgtcaccctcgcccgcggcacaaactacttcatatgcagcatccccggacactgccagtgccggcatgaagatcggcggggccagcagctaagtggcctggggcatggggcatggtggacgtggctggggcgcgcagcggggtggggcgcaggagggatgttggggatggccgaagtaaaaagagaaagtttattagttgcgatggatttacatagaggtatagaaaaatacttggtgtgttggtgggaggtgctaggagaaagatggggggtgctgcgagggaaggtaggcaggacacggggagaccgatggcattcgtgcgtgtagaggcaagcatctgttgggagaaatggacgtagcaggagaggacaggtggtgtaggtatgtgaatataatatgagtggatggacgaggagagggggggaaaag

SEQ ID NO: 529 - DNA, 3480 bp, Hordeum vulgare
ccgagtcaaggtctcctcctcagtcctcctcctcgcaccagcgacctccattgcgaccggcaggcagagtcaaccaactgtcagggcggacaggcatccggccgactctcttttgattcgtctctatgtgtcaagttatcatctttggattggatgatagctccgtgccccgtgtttgttgatgccaaatcgccactgtctctgcttgactgaatagcagtttcgtcgtcgtcggcacaaatggcggaggcggtgcttgttgctctcggaaagattgggaatgttttagctgatgaagctaccaaagctttgctggccaagctgtcagaaaaagttagtaatctgattgatctggatgacaagattgagggaatagcgaagcaattaaaaaccatgaacaatgtcatacagcagataggcacgccgtaccttgccgacaaagtcgtaaagggttggattggggaggtgaggaagttggcctaccatgtcgaggatgtgatggacaaatactcgtatcactctcttcatgtcgaaaaagggtttctgaagaagtgcctcaaaggatcacattatgtccgggttttcagtcaaattgctgacgaggtagtcaagattgagaaggagatcaagcaagttatcgaactcaaggagcagtggctccaaccatcccagcttgttcatgaccctctcactgagatggaaagacaacggtcccaagatagcttccctgaacttgtgaaagatgaagatcttattggaattgaagataacaggcgaatgatgactgaatggttgtactcggatgagatggagactacagtgataactgtgtcaggtatgggtgggttgggaaagacaaccctcgtcacaaatgtgtatgaacgtgaaaaggtcaacttccaaactagtgcatggatggttgtgtctcagacctacactttggatgctctgttgaggaagttactcgagaaggttactgaacaaccatcatcacctaacattgacaggatggatgtgcatgacttgaaggaagaaataaagcgaaagcttaaagataggaaatgtttaattgtattggatgatgtctggaacaaggaagtgtactctcaaatgcgagatgcattccacaattctcatgcaagccgcgtcatcatcacgacgcggaacaatcatgttgctgctgttgcccactcgacacgtcgtatcgatctcaagcctttggggaatgctcacgcattcgaactcttctgcaggagggtcttttatatcaagaaggaccatgtgtatgagtgtcccaatcatctcatgaaaactgctaggtctatagttgataggtgtcagggtctgccactagcaattttatctataggcggtcttttgtcttcgaggccacaaacacaatactcttgggagcagatattcaatcaactctcaactgagctgtcgaacaatgataatctccgggcagttttaaatctgagctaccatgacctatctggagacctcagaaactgccttttgtattgcagcctcttcccggaagactacccaatgtcacgtgagagccttgtgaggctgtgggttgcagaaggctttgtgtgtagcaaaggaaatagcaccccggaggaggtggccgagggaaacctcatggaactgatataccgcaacatgcttgaagtcaaggagacagatgaactgggaagggtgagcacctgtacgatgcatgatatcgtgcgagacctggctctttgtgttgcgagcgaggagcagtttgtatgcgcaaatgattatgccacattgatacatatgaataaggatgttcgtcgtctgtcatcatgcgggtggaaaggcaatactgcactgaaaattaagcttccccgtcttcgaactctagtgtcagtaggagcaatttcatccacgcctgccatgccattctcgctttcatcagagtccaactacctgactgtcctcgagctacaggactctgaaatcactgaagtgccggcatggatagggacactcttcaatttacgttacattggcttacgccgcaccaaggtcaggtcactcccggactctgttgagaaactatcgaacctgcaaactctggacatcaagcaaactaacatagagaccctaccaaaagggattgttaagatcaagaatctacggcacctcttggctgatagatatgctgatgagaagcagtcggagtttcgatactttatcggaattcaagccccaaaagcactgcccaacatgggagaattgcagacccttgagaccatccaagccagcaaagacttggccgagcagctggagagaatggtgcaactgcgaactctgtggattgacaacataagttctgctgaatgcgcaaatatttttaccgccctatcaaacatgccgcttctttccagcctgcttcttgctggaagagatgagaatgaggcgctttgtttcgagtccctccagccaatgtccacacatctccacaagctgatcatcagagggaaatgggccaagggaacactgaactgcccgatatttcgcagccacggagaaaatctcaagtatctagctctaagctggtgtcacctttgggaagacgaggatccactagggatgcttgcaccacacttgccgaacctcacgtatctgcgactcaacaacatgcgtagtgcaaacattttggttctttctgcagattcctttcctcacctgaagagtcttacactaaagcacatgcataatgtcaacgagctaaagatcattgatggcgcccttccgtgcatcgaaggtttgtatgttgtgtcgttgtcgaagctggataaggtccctcaaggcattgaatcccttagctccctgaagaagctctggttggtgggcttgcatgggggcttcaaaactcagtgggacaagaacggaatgcagcagaagatggtgcatgttcaggaggttcgtgtctgaaactctgaatgcagcacagtggttctttcagttgtagcattctggtatggtgcatcgacgccattctagcttcaatcattctggtatgctataactactaagccatcatttgcgagtcttgtacttccatattgtgagacgatttctgttcagaaagtattggtgtccattgccttcaggaggccccgtacctttttgtgttatttcagtttcatgctgtaatactgatttcaggaaacagttgtatcgaacatgtgagaaaacaatgttgttaaatttgtttaaaaaaaatcgaaaaaaaaaaaaaaaaaaaaaaaaaaaaaaaaaaaaaaaaaaaaaaaaaaaaaaacaccctcgggggggggccggggccccatttccccctatagggggtcttattacccgcgctccctggccgtctttttacaccgtcggggggggaaaaccccgggggttccccaatttattcgcttggaagcacatccccttttccccagggggggtaaaacc

SEQ ID NO: 530 - DNA, 616 bp, Hordeum vulgare
gattatgggctttgtgagggggagaacatgcggcgcgcggctgaggttctaaggaccatggttaataaggggcttgaactggatagcatcacttataacataatgattcaaggttgctgcaaagacaataaaatagaggaagcaattaaactccgtgatgacatgatcagaagagggtttaagcctaatattttcacgtttaatactatactacatgcgtattgcattttgggtaaaatggaagaggccattcacctgctggatcagatgaaaattgagggacttcggccagatatagtgtcatatggcactataatagatggatattgtagaataaaggatattcataaagcaaatgaatatttgactgaattgatgacccgtggattagaaccaaatgtagtaatctacaatgcacttattggtggttatggtagagttggtaacatttctggtgcaatggatgtccttaacactatgaagtctactggcataagaccaactaaggtaacttactgcagtcttatgcactggatgtgccatgcttatcttgttgacgaggcgaagaccatgtttgagcaaagcagagaaaacagcattgaggtgggagtaattg

SEQ ID NO: 531 - DNA, 975 bp, Hordeum vulgare
aaaagctttctcgttctcagtcagagtgtcggtcactccccctcctaaaccctaaacccagccgccgccatggccgccgccggccgcctcttcctgcgacgccgcctcgccacggccgccgcgacgcctccgaccccggcttccatcctcaacccttcctccccgaccaccccgctaaccacgcggcagaagacccgcctcgccatctccctcctcaagtcctccccgccgccgccccccgaccagatcctctccatctgccgcgccgccgcactctctccgaagacccacctcgaccgtgttgctctctccctcgccacctcgaggctctccaccgccccggactccctccgagacctcacgtcctcccttctcatccccgaccacgcccaccacgccatcgtgctctttggtcaggccggcctcctccccgacgccatctccaccttccagtcatccccctccacccgctccctcaacgccctcctttttgcctgcatcgtcgccggcaaccatgccgaggccgctcgcatcttccagaccttccccgacgcccaccgcgtcaagcccaatgccgagacattcaactccattataaaatccttctctgagtctggcaccacaagatccttctactcggtgttcgatgaaatgtgcaagcagggcgtgaagcccaccgccaccacgtttactgccgccattgctgggttttacaaggaggagcgctttgatgatgtagagaaggtgattaagctcatgaagaagcacggttgtggcgagtcactgcaagtgtacaatgcaagggttcaggggctgtgcaagcttggccggaatggtgatgccaaggcattactgagtgagatggccaagaaagggaccaagccaagctgggttacttataaccatttgatttatggattctgtaaggaaggggatttggaggaagtgaagcggctgtacaaggagatgggaatg

SEQ ID NO: 532 - DNA, 458 bp, Hordeum vulgare
aaaaaaacaaaagaaccggtaactatccggtaatcacattttacacaagtgcgcagcagcctgaaccatcaacctgctgcttctcaagttccaaaaaagaaaagaaaaactgctgcttcttaagacgaatgaactaacggcagcactagcttagtacagtaagtatcacaccatcactctaacctaaaactcctcctggactggactggactggacctgacgtaacgtacgtacgtgttagctgcttcactcgagcggcgtctcggccgccgctacagatactgcgtgtgtatccggtcccggttctgctcccaccacaccttggcccgctcctcgccgaaccgctcccggttgaagcggacgcggcggagctcgcgggtgccgtcgccgagctcgcggacggtgatgtgcacgccgggctcgtcctgctccacccactccgtcgcctccaggtcgct

SEQ ID NO: 533 - DNA, 577 bp, Hordeum vulgare
  misc_feature (481)..(481): n is a, c, g, or t
cgctaaggtgtgaaggggcaggcagatcgtctcgtctcccccatcctgccggcattgatctgtcctattcttatcatccatcaatggggaggccaccttctagtgatgagaatggcctcaagaagggcccctggactagtgaggaagacgagaagctcatgagctacatccagaagcatggccatggaagctggagagcccttcctcaacttgcaggcctgaacaggtgtggtaagagctgcaggctaagatggaccaactacctgaagccggacatcaagagagggaagttctcccaggaggaagagcaaaccatcctccagctgcacaccgtccttggcaacaagtggtcggctatcgcaaagcacctccctggacggacagacaacgagatcaagaacttctggaacacccacctcaggaagaagctcatcaagatgggcatcgatccaatgacccaccgtccgagaacagacttctntgctgctctcccgcagctcatcgcactcgccaaccttcgccagttcatcaatcagcagccgtgggatgaccacactgccgggctgcagagcagaca

SEQ ID NO: 534 - DNA, 1577 bp, Hordeum vulgare
  misc_feature (56)..(56): n is a, c, g, or t
tttttttttttttttttgaacaactctgagaggttcgtttcaccgctggggcaatncgtgcgagcttccacagcaaagtacatgcataaaatgcattgcacagcaaacctaccgatccccactacgctcacacgccatatgcgactctaccatcaactctacaatacgaaataggaaaagtacacgcacaagaccaacacatatttacaagaaagctagcaaacgctaccaaaacttgcacacacacgcgcgacacctgctttgctattgttttccataaagaaaaaagacacctgctttgctatgggctgtggctgctcaccgtcgccgttctaggatcttgtcagcacgcgtcggagaggagccaactgacgaacgactctagctcgtccgactcggagccggtcgccacctgcggctcagcgggctggagcaggccattctgcgccggctggtcccatagattggatgcaaacccctcccagtccatgtccaagagatcgtccacttgagacaggcctccgggatctatgccactctctgccgtaacgctgctggacagcagtgcctgcacctcgctctcgtcctccaaaatcccaatctgatccatgggattgctcacttcccagagccccatctggtgctgatctaccgtgcagttggcctccagggcatccgtctgatctaccacagggtccatgaccatgggccacgtcccgtcctcgctgcagggcccatcagaggtgttgctgacgctaatgctgttgttgggctggttctggtccgggtcgaccaccgcgcttctagcctcgtcgctctgaggcgggcttgacgctgttgacgaggtgccctttgcgttggtgacgggctcaggcaccggctgcttcttctttgtactgctctttggcgactggcctggggtccggccgccgcgccgcttcccgggcggcggaaagcttgtggatgtcgacggttatggtggtgtccctgacggtggtgtatatccgccggaaggtgtggatctgccggctgagatgggagttccagtagttcttgatttcgttgtccgttcgtcctggtaggtggctggcgatcagggaccacctgttgccaagggtggcatgaagtttgacgatgaggtcgtcctcctccttggagatgttgcccctcctcaccccgtctctcaggtagttgatccaccgcagcctgcagctcttgccacacctcagtagccccgcgtgcttgggtagagacctccatgagccctcgccgtgctgggcaatgtagtttgcgagtatgtcgtcctcctccgccgtccaccttccccgcttcagccccaccttctcgcagcacggcgccctccccatccccttgtatacgacgagcctccctatatatctcccaacacacgagcaaaccgcccgttgtcgccggccgaggctagctagctagatactatagcaggtcgagcgcggtgggtgtagacgtgtagtcgatccgcgctcgcgtccaaaaggagttagtgtgagagatcaaggggatgggcgatgatcttcctttggcggccctgatctata

SEQ ID NO: 535 - DNA, 1277 bp, Hordeum vulgare
  misc_feature (901)..(901): n is a, c, g, or t
  misc_feature (1234)..(1234): n is a, c, g, or t
ggctgcaggctcatccgcgctcctctctctctctctacatctgtcttccatcctccactggccacgtcatccatggatgtggtgctgcaaagtcgtagcagcaacaacatggcggccgagcaggaggaggaggcggagctccggcgggggccgtggacggtggacgaggaccttacgctgatcaactacatctcggatcacggcgagggccgctggaacgcgctggcgcgggccgccggcctgaggcgcacggggaagagctgccggctgcggtggctgaactacctccgccccgacgtgaagcgcggcaacttcaccgccgacgagcagctcctcatcctcgacctccactctcgctggggtaaccggtggtcgaagatcgcgcagcacctcccgggtcggacggacaacgagatcaagaactactggaggaccagggtgccgaagcacgcaaagcacctcaactgcgatgtcggcagcccccaccttcaaggatgccatgaggtacctctggatgccccccctcgcctagcgcatccacgccgccgccaccaccgccactggcggcgagccctcaatcggcgacacgtcctgcgcgtcaggagtcacgttgatggctaccgccgtcgccaccgccaccgcatgcccccgagaacaactctccggccagcgcggtcaccagcagatcggcatcgtcgggttcgatcacgtcggagctctgcggcgacgagaagaacctgcatgtccatggcaacgacgataagacaaccagcggcggggactggcccgatgcaggacgttggaccaagagttctgggccatgcatatgcagatccagcctgacgacggtggtcttttccaagaccatgagcttagtggatgggtgcagggcttctccgangtcggcgtttcggctgataacctctggagcctcgaggacatatggaagatgcaatgatttttccagtgattgaggagcgatttttatacttatatacatgtgtatcatagaactggtacagtagatcatatacaccggagtaaggatggccgcaaacttaactacgagctaactaattaattttctttagagctaacgttagtaattactattactactaatgtgcatcacagtaagtgtaaggcactaggggttcttcgttggatcttgttttactttttgtgccttttccacccatgaagggttgttttgccttgtgtggctcaatggccnaaaggagagatgatgacagcattatatgtttaaaagagtgtaa

SEQ ID NO: 536 - DNA, 507 bp, Hordeum vulgare
  misc_feature (398)..(398): n is a, c, g, or t
  misc_feature (407)..(407): n is a, c, g, or t
  misc_feature (464)..(464): n is a, c, g, or t
  misc_feature (470)..(470): n is a, c, g, or t
caccgagagagaaaggcagaggacatggggttggaagccatgctgctccaaggagggcctgaacagaggagcgtggacggcaatggaggacgacatcctggtctcctacatcaacgagcatggcgagggcaagtggggcagcctccctaaacgagctgggctgaataggtgcgggaagagctgccggctgcggtggctcaactacctccggccggggatcaagagaggcaacatctccgacgacgaggaggagctcatcgtcaggctccacaggttgcttggctacaggtggtcgctgatcgcggggcggctgccggggcgaacagacaatgagatcaagaactactggaacaccaccctgagcaagaggaaccatcagtcagccccacccccacggngccggctgntcgagccacccgcaggccaagccgccgccgccgtcgccgccgtcgtagggcgcgggncagcancccgatacggaatcaaggcgctgtggtgcaccaccgc

SEQ ID NO: 537 - DNA, 740 bp, Medicago sativa
cggccggggaaggttgttgtggtcttccccttgacttcaccatagccttctcctaaatcattaataatctcttatatttcattctttaccttaacttatggatggaagttggggtgaaggaaagagaatctatgagtacagagaagaaaatgagtatgaagtagaagtagaaatagaagaagaggaagatgtgagttatggagatgatgagaaaaggaaaagggtggtgactgatcatctttacaacaagaaagggtcaaaagctggaggatcagtgacaccttcttgccaagttgataactgtaatgctgatctaagtgctgctaagcagtaccataagcgccataaggtttgtgaaaaccattctaaggctcattccgtactcatttcagagcttcaacaaaggttttgccagcaatgtagcaggtttcatgaggtatcagaatttgatgacttaaaaaggagttgtagaaggcgtttagctggacataacgagaggcgtcgcaaaagtgcatccgaatatcactgagaaggaattcattgatgatgatcaaacatattgagcagcatatatagttgaaataaagacaccatccttgagttcttcatattcaaattgatgttattcgtggaagctctctctcttctgtcatcaaactttatctccctctttatgctaagtttgctgctccattagatcgagtataattttagctgaaaactaaaaataacttgcttga

SEQ ID NO: 538 - DNA, 751 bp, Medicago sativa
cggccggggctcctcctcatatgaatagtttgagttttctccacattaataaccttgttttgtttctagatctctctggtctttttcctcgaaactatggagacaagaaggtcagagggaaaaagaagtttgaagtacaaagaggatcatgaggaagaagaagaagaggaagaggatacggattttgaagaggaagaggatggtagaaggaagagggtagtgacagatctctatagcaagagaagttccaaaaaagctggaagctcaaacattccaccttgttgtcaagtggagaattgtgatgctgatcttagtgaagctaagcaatatcaccggagacataaggtttgtgagtatcatgccaaagcacctgccgtacacattgcagggttgcagcaaaggttttgtcagcaatgtagcagattccatggactatctgaatttgatgacgcaaaaagaagttgcagaaggcgtttggccgggcataatgagaggcgtcgcaaaagtgcaattgactatcaaggagaatgatttcatggttgaaacaaaatctcaggttcaagcccttcgtatgttgctggtctctaaggatagaccaatgctctctatcttctgtcaatcttttatctatgtatgcaatgatttctgtttgctgctagttacatctatctatgtcatgtaatatttaattttctcacttagactacttatcattaaaatcatgcatgaacacatgacatttgaattttgc

SEQ ID NO: 539 - DNA, 704 bp, Medicago sativa
caatttcttatgcaaaccctatgtgtgtctcggggtcatatgatgcctgatccacacctcacgtgtttgaagttggggaagaggcattattttgaggatgtgagtggtggtggtggggtgatgggggagaagaaagggaaaggagggtattgtggtggtgggaagacggcggcggtgggaggttatacggcggtgacaaggtgtcaggtggatgggtgtaacgtggcattgatgaatgctaaggagtatcataggagacataaggtttgtgagatgcattcaaaggcaccaaaagttgtggtgttgggtttggagcaaagattctgtcaacagtgtagcaggttccatgttgtatcagaatttgatgattcaaaaagaagttgtagaaggagactggcagggcacaatgagagaagaagaaagagctcccatgattctgttgggaggaattcctcacaaggtaaaacttgactcttacttattgcaaaatctttggtagttttttgttacttgtaatcaggtgggtgtgctctctctcttctgtcatctcggactgattcatggctttcaccggctgacctctccgtaagatgcagtgctgcattaagcgaattgatagcagaaaaccgagcatcgataatggctaggcaatatgtctcagacagagaacctaacaaatcatcatcattaacatcgtcactttc

SEQ ID NO: 540 - DNA, 1254 bp, Medicago sativa
accttacacaccaatggattcaggaggcaactcttcttcagaagagtcctcacttaatggcttgaaatttggccaacgaatctatttcgaagatacagctcttactgctgcttctgctgctgctgctagtactaccattgctgctggttctccttcttcttctggttcaaagaaaggaagaggtgggtcagttcaacagttctcaaccacctaggtgtcaagttgaaggatgtaaactagatctgactgatgctaaagcttactattctagacacaaagtttgtagcatgcactctaaatcccctactgttactgtttctggtcttcaacaaaggttttgtcaacaatgtagcagatttcatcagcttgctgagtttgatcaaggaaaaagaagttgtcggagacgactagctggtcataatgagcgtcgcagaaagacccccacccagctctctcttaacctcacgttttgccaggctttcttcgtctgtttttggtaacagcgacagaggtggcagctttttgatggaatttgcttcaaatccgaaacatagtctgaggaattcacccggaaatcaaaccacagcaatcggttggccttggccggggaacacggaagtcgccatctaacaaccttttcttgcaaggttcggtgggtgggacaagcttccctggtgccaggcatcctcccgaggaaacttacactggagtcacagattcaaactgtgctctctctcttctgtcaaatcaaacatggggttctcaaaacacagaaccaagtcctggattgaataacatgctgaatttcaacgggacacccatgacacaacttggtacatcttctcatggtgtagccatgcatcaaattccaaacaattacgaggttgtccctgatcttggtcggggtcacattttgcatcctcttggtagccaacactctggcgagcttgatctgttgcagcagggaaggaggcattatatggatgtagaacattccagggcctatgaatcttctcagtggtcactgtaatgcacttgtttgctttcaggtttgtaataacatgtttcacaaatatttgaactcaggaaaatgagaagtgaactagggcatgcttgatgctatttcttgtttttgtttgtttaaactgtttggcaaggtgggcctagctttgcttcatttgtggaactttcagtaacttttttaatgattgctaagtgagagggcatccacttcgtggtttggtatctcttccc

SEQ ID NO: 541 - DNA, 1344 bp, Medicago sativa
atggagtggaacgtgaaatctcccgggcaatgggactgggaaaacttattcttcttgaattcaaaagcagcagaaactcacaggttacaatctactgattggagtatggaggaagatcgagaaatcaatgttgggatgttgattccatctggtggtagcggctattcagtgtctaaactaatgcatgcttcatcctcgaggagctcaaaatctgcttccaataattcatcatcaaatgaggacagcaagacatcgatgttaactcaagaaggttctccagacaattccaccggtaagaaagaatcgtctaaaggagatccaattgaaacttctccagcagcagaaccattgctcacactaaagcttggtaaaagattatactttgaggatgttagcactggaagtcattccaagaaagcctcttcctctgcagttcctcttttgtgcggaaagaaaggtaaatcgagcagtcagaacatgctaaatccaagctgccaggtggaaggttgtggcctcgacctctcttttgctaaagattaccatcggaaacatagaatttgtgacagtcattccaaatcgcctgtggtggtagtagctggtttggagcgtcgattttgccagcaatgtagcaggttccatgatctctcagagtttgatgataaaaaaagaagctgcagacgccgtctttcagatcacaatgcaaggcgtcgcaaacctcagcctgaagcagtgaaattgaatccatcagctctctcttcgtctccctatgatgggaggcaagcaatgggcccatttgcttttccaaagaatacttcaaatttagcatggccagacatgcccaacagcaagctcccccaaaccaaagattttatgctcaaaactccaaaaaacttcaacaagattgtcactatgctttctgatgattcaagtggccactttatatccaaaggcaaaggaaccaatattgctgtcccagaaacaactgttattcacattgatagaatacatattacaggtctagaagatccaaataccttgtctgatccaagtgctacacaagatgttaaccgtgctctctctcttctgtcaaccaattcatggggtgcatatgataccaagcccccctccttcgtacactccaatcggacaaccggcacccctcagtatgcaactgctcagcgctcacctttttcgtcaccggaatattggcacactgatcaacatcaggccagctccagtgcctgtatctcgttctcgggttacgacaatagcaatcgctatcaagactttcagctgttcagcgaaccctatgagtcaagtttcccttgcaaccagctggattaa

SEQ ID NO: 542 - DNA, 1461 bp, Medicago sativa
gagcgattcccttctctcaccatcaccacctatcgcctctgcctcacttccacgtgcatattgagattcatgagtagcacttcaagcgaacactatggtgatcacaaaactcacatattgagagtcatgaatagcgctttaagcgaagatgatggcgatcacaaaacaggcatattgagtggtatgagtagcccttcaagcggcgatgatgatcgcaaaaggcagtcaatactgtcagctgatcaagaaactgatgaaggagataccactggaggagaaggaggagaaggtggtctaaagaaaggtccatggacagcggcagaggatgaaatcttggtagctcatgttcaaaaatatggtgagggaaactggaattcagtccggaaatgtaccggacttgctcgctgtgggaaaagctgtcgtctacgatgggcaaatcatttgagacctgatctcagaaagggtgcaattactgctgaagaagaacgccgaatcattgagttgcatcataagatgggaaataaatgggctcaaatggctgcactgttgcctggacgtacagataatgagataaagaacttttggaacacaagatgcaagaaacggggtcgggcaaacttaccaatctaccctgaagatttatcatctgaatgtctgctgaatcaagaaaatgctgacatgttgacaaatgaagccagccagcatgatgaagcagagaacaaagtacctgaagtgatatttaaagattacaaactccgccctgatattttaccaccatgttttgataagcttctagctggcttgttattgcgtccctctaagcgcccttggaagtccgatatgaatttgtacagttatagcaataatgctgctgccccagcagcatttgatcagctcagaaaatatcctatgccatctccttcgtctcctccatgggaggatattaatgaaccacatagctacaatcagtttaatgaatatgataaccctatggtcggtattcacatggcaccaaaaacctcttcttttgagcccatatatgggttcatgaagactgagcccccttcactccaatattcacagactcaacatcgtagctatatgattccatatcctcaagttgagcctgttcagtcagttccaacttctctagagaggagtcattttcttccatccaatgaagcaaatcttagcacacaatgggatgagtcagatgatcagtatgatggtttatttccgtcctttgactataataacaataatcatatgaacacgtgctcaactgacgggcaccactcagctgaaactactcagggtcatgatattattaaccatgctgcatttaatcagatcccagattacttttcttctgagagagatgatttgaggagaaaaatatttgcgcatccagatgctgcgcctgtggttgatgacttcgcttggtattataaaatagaataa

SEQ ID NO: 543 - DNA, 1934 bp, Medicago sativa
  misc_feature (1921)..(1921): n is a, c, g, or t
ttcacattttggtcggcaactgttgcgtaagaaagagagagaaagagtcttcatctctacttaaaactttgcaactctttctcactcaccactcttcttttcctttctcttctctctctctctctctctctctctctctcctttttcctcatccacaccttcactttctcttcacaacaatctcacccttcttcattctaaaaacatgtttgtagttatggattccatggaaaaaacctctgaaaagtgcttagattcacaactatggcacgcatgtgctggcgccatggttcaaatgccaccactcaacacaaaagtcttctactttccacaaggtcatgcagaacatgctcataacaaagttgatttttccaaaacccgtgttccacctctcatcccttgtagaatctctgctatgaaatacatggcagaccctgaaactgatgaagtctacgtcaaaatgaaactaactcctttaagagaaaacgagttagattttgaagaagatttgtttctttggaaacaatggcttagagagtcaagaaaagccagcttcttttgcaaagacattaacacaatctgatgcaaacaacggtggaggtttttctgttcctagatactgtgctgagactatttttcctaggttggattattcagcagaaccacctgttcagacaattattgctaaggatatgcatggacagtgttggaagtttagacatatatatagaggaacaccaaggagacatcttttgacaactggttggagtaattttgtgaatcataagaagcttgttgctggtgattcaattgtgtttttgagagcagaaaatggagatctttgtgttggtataaggagagcaaagaaaggtggaattggtggtggaactgatcagttttctaattcttctagtacttggaaccgtgtatcacctttgtttggtggtgttggttctggtttcttgtgtggaaatgataacagaaaaaatggttgtgatgatgttgatgggaaaagtaggagctgaatctgttgttgaagctgtaaatggtgctgttaatggaagatcttttgagggtgtgtattatccaagagctagtactcctgaattttgtgttaaggtttcttcagttaaatctgcaatgcaaattcaatggtgttctggtatgagattcaaaatgccttttgaaactgaggattcttctaggattagttggtttatgggaactatttcttctgttcatgttcaagatccaattcgttggcctgattctccttggcgccttccgccgcgagggtgggatgaaccagatttacttcaaaatgtgaaatgtgtaaacccttggttagttgaattagtctcaaacatgccaaatttcaatctctcaccattcacacctccaagaaagaaaccaaggtttatccaagatccatattttcacctcatgaatcaatcatcatcaccatcaatctcccacattaatcttctcaattacacaaaatcttctctctgtaacattcaagacactaccactaatagttcttttgcatcaagcatacagggagccaggcatgctcaatttggaccaaattataataatccatctgatttaattcccttcaacaagctactacaacaagacatgtttcttggtaatttgtcattgtcaaggtttaatcaacaacaacctataactaggcctccttatggaccctacaagagtatcaataacaataacaacactaagaccaatgttgacttgtcttgtttgttgagtgtgggaaattctggtcaaagttttaaggaatccaatattgaagcaaaagcaccccataaccataaccatattttgttatttggaaaaatcattcacactgaacaaaacagttcaaatatttcaaagagtgattctgtttctgaangaacttctttgaa

SEQ ID NO: 544 - DNA, 631 bp, Medicago sativa
gtgaagcgagtaagtccatggttggttgaattggtatcaaacatgtcgatgattcatctcgcacctttctcaccaccaaggaagaaactccgttttccacaacatccggatttccctctcgatgttgtccagtttcaaataccaacgttttcaggcaacccttttaaccctttgtgttgtttatcttcttcggataattataacgctcctgccgcaggcattcagggagccaggcatgctcaaattggaatatctttatcggatcttcaccttaacaacaacaaatttcagttaggtgtgtttccaaataatcgcgagacgatttctaatgttagcaacataactaccaaccatgataataagagcaaagaaagtatatcatgtctgttgactataggaaattctcacaagagaagtttggagatcaaatctgataataatgataatagacaccaatttttgctttttggtcaaccaattctcactgagcaacaaatctctagaaaagattctagtgatgatgtgttgttgtccaagaaaaaggacaaagagaagtggtttttcagtgatactactcaatcttctatttctgaacagttttcaccagcaaaatcttctactactagtgcta

SEQ ID NO: 545 - DNA, 1860 bp, Medicago sativa
atgaaagaaaagagaaaaggttgcagtccaactgagatgaatatggagtcaaagaagaaattgaaaaatgtgaacaagagtgtggaccctcagctatggcatgccgttgcaggaggaatggttcaaatgccagaagttaactcacaggtcttctacttccctcagggtcacgccgagcatgcttgtgagcctgtgaatttcagttcttactccaaaattccgtctttcattccatgtagagttgaagctataagatatatggctaatcatgagaccgatgaagtgtatgcaaaactcagacttgtccctatgaatattaaccaggttagttttgataatgatggtgttgctggcatcaacgtgtccgaaacaaaggataaacatcaatcttttgcgaaaaccttgacacaatctgatgcaaacaatggtggtggcttttcttgtcctagatattgtgcagaaacgctttttcctcgtttggactattcagctaaccctcctcttcaggatatttttcccaaggatgttcatggcgaaaagtggcatttcaggcacgtttataggggcacgccgaagaggcatttgttgacaactggatggagtccttttgtcagcgacaagaaacttgcgtctggggattcgattgtgtttttgagatctgaaaacggcgatcttcatgttggaattcggagggctaaaaggcgaaataatgttggagtcgatcctttgtcagggtggaaatctggtagtggaattggaatttgtgctgcaccaccttacggaggatttccatcgttttcgggagaggaagataataaacttcgaagaaacggtaaaggtaatggattgctaataagtgatggaatgatgggtagggggaaggtgaaagctctagaagttattgaagcagtaagactcggtactaatatgcagccgtttgatgtggtttattatcctcggtcgggtactcctgagttttttgtgaaaacttctttaattggaatggcacttcagattaggtggtgtcctggaatgaggttcaagatggccattgaaaccgaggactcatcaaggataagttggtttatcggaactgttgcttctgttcaggctgctgatccgtcatggtctgattctatgtggagacttctcgaggttacatgggatgaacctgagttacttaaaaatgtgaaaagagtgaatccgtggcaagttgaaatagtatcgaacatgccttcgatccctctttcgcctttcataccgccaaggaagaaattgagattgcctcaactcccagatttcccaattgatggccaatttccaatgccaacttttccaaacaaccttctaagtcctaatattccaattttttatttacccgaaactagtcctgccggcatgcagggagccaggcatggtcatttcggtgttaccttaccagattttcataatcttccattaggtctctttcagcctagtttccaacaaccgtttaataatattgcgacaatgccgatgactgtccctaataacccggcattgcaaaagccgaacaccagtgagaacgtttcatgctcgcattcgatatcaacttctgcacaatcttcagagaaaccggatcatgcaaagccgcaccaacttgtgctttttggccaaacaatacaagttgacgctggaaatgaaaattccgagaagaaaatgtctaatcatttgtctgatcttcatctacaaggcctgtcgtcaagatcatctgatgcgaggttcgagtggaatgctgagaaccaacacgaagaaacattggcaggagaaacattagagatgaaacattcagagacttcatcagaaaagctaggaggttga

SEQ ID NO: 546 - DNA, 1575 bp, Medicago sativa
atgtcttctcagcaacgccgtgttgatcagaaaatctggcagtgctgtgcaggcagttccgttaaaattccaaaactatattctcatgtttactacttcccattagggcacttagaacacatatgtccatccccaaaccctaacacactgtcccatcttgaccgttcccgtccattcattctctgcacagtctccgcggttgatctactcgctgacctttgtaccgatgaagtcttcgtcaaactactcctcactcctgtcactaacaaaggtgttcacgaacctcactctcttgaggttcgtgaagacaaagatgatgacaaaaaggttgtttcctattccaagactctcaccccatctgatgctaacaatggcggtgcattctctgtgccagtggaatgcgcgaaattaatcttcccgccacttgacctcaatactgaaaagccgtttcaagaactctccatcagtgacattcacggcaaagtttggaagtttcgccatgtttaccgtgggactcccttgcgacatctgcttaccactgattggagtgagttcgttgacaagaagagactagttggcggtgattccttaattttcatgaaagactcagatggaaatatctcagtcggggttcgccgacagactaagtttggtggtgctgctaagataacagaaaaatcgtttacggaggcagtggaattggcggataagaacttggcttttgaagttgtgtattatccaacggctaaaggttggtgtaattttgttgttgatgccaaagttgtggaggatgcaatgaatattagttggagtcttggagtgagaattgaactttcttcgaagaattacgattcttcaaagagatgctcaaaatttgagggaacaatatctgctctatctgctcctaattgtccatggcggatgcttgaggttaaatgggatgaacctaaagtctcgcaggttccagagcgagtcagtccttgggaggttgaaactatttccgacatatttgcactgcatccacaattccacccgacaaaaaagcttaaaaaatctgatccagattctgctgcattcagtgataaaaagggagactccttcatcccaaatatagaggcttttttgaagatggtcccaaatatagagtttaaacatttcgtgatgacatcctctaatcaaacattgttgaacaatgatgcttttcttgatagcatgcagggcgccaggcacggacttttttccacatcaacttcttccaactttgggaatgataaaagcaatggtttccttgggaataattctatggcagtgtcgagtaatgtgtcaagtgagccaaacactgcagctcctatatctttggacttgtcacctcatagccatgatatttccaactctcgtgggacaaagtttgccggtactgacagcagcaccgagaaagtaagtcctggttcatttatgctatttggtaaaatcataaaacctgttagaagcgattttcaagaattcgatatcaagggaaatgatgattgtgaaggctccaatgaaattgaaggcatcaaacttgcacaaaaatag

SEQ ID NO: 547 - DNA, 2181 bp, Medicago sativa
atgtcttacgacgacgtggagattgaagatatggaatggaacgaggagttacagtcatacacgtatccatgtccatgtggagacctgttccagatcacgaaagaagatctcaagcttggcgaagaaattgctcgttgccctagttgctctctctacatcaccgttatctataatatggaagattttactgccgattctaataaggctcttcagccatccaaacaacaacccgcgcgattggagagtagcgttccacttccagccaagtacttcatttcagagggaacttttcatcattcgttcgccatgaaattcctcaaaaccttcaactccaaatccatttaccgccattccaaaacactctcaaattcctcgctttacactactactacttccgcacccccatcaccaccaatcaccgaaaccaaattccttgaatacatccaaacttctcagtggcatttcatcaaacaccttgcccccaacctcaccccttccctcctctcttccactcttcccacccttcaccaaaacccaatcctcgttgaaaccctcctctcccaccttcaccgccaccctcattgtctcgacctcaatactcgttgcatcaccttatgcatcctctaccgtctcccatctccaaaaccatctttccacatccttcaacccatcctccacaccaccacccccaccgtcattttcaacgaattatcactagctcgtaaccgtctcaacgtaaaaaccacccttgtctttgaccttctccttagtgcttattgccaatttcgtaaacctgatgaagctttagagtgtctcaatttgatgaaagaaaatgagattatccctaaaaccgagacttgtaattcgcttttgagtttgttattgaaactgaataaaatcaagatggcttggtttgtttatgaagaaatggttaagatgaatatcaaatccagtattgttacttttaacattatgatcaatattttgtgtagagaaggtaagtggaagaaagctaaggattttattggccatatggaggtttatggtgtgaagccgaatgttgttacttataatacggttataaatggatactgtttaagaggtaaatttgaagcggctagtaagatttttaagacaatgaaagataaaaatcttaaaccggattgttatacgtataattcttttatttctaggttgtgtaaagaaagaaggattgaagaggcatctggtgtactttgtaaactgttggaatctggattggttcctaatgctgtaacatacaatgcgttgattgatgggtgttgcaataaaggggatttagataaggcttttgcttaccgggatgagatgatgaatagaggcattgtggcttctgttttcacttataatttgttaattcatgcactgtttttggagaagaggatagaggaagctgaagatatgataaaagaaatgagagaaaaaggggtggagcctgatgttgttacgtataacatacagattaatggctattgcagatgtgggaatgcaaaaaaagccctctccctttttgatgaaatggtggagaaaaatattagaccaacagtggaaacatatacatcgcttattgatgtttttgggaaaagaaataggatgagcgaggcagaagagaagtttaaaaagagtataaaagaaggtatgcttccagatatcataatgtttaatgcattgatcgatggtcattgtgtaaatggtaacattgatcgtgcatttcaacttttgaaagagatggataatgctaaggttgttcccgatgaagtcactttcaataccttgatgcaagggtactgcagggagaggaaagtggaagaagctaaaaaacttcttgatgagatgaaggaaagggggatcaaaccggatcatattagttacaatacactcattagtggttacagtaaaagaggtgacatgaaggatgctttagaagtttttgatgaaatgttgtctctaggatttgatcctacccttcttacttacaatgctcttattcaaggctatagcaaaatcggtgaagctgaccatgctgaagagctcctcagagaaatgcagagcaaaggcattactccagatgacagcacgtacctatatgtaattgaggcaatgaagacaaatgatgatctagtggaaaatgatgataagtga

SEQ ID NO: 548 - DNA, 1653 bp, Medicago sativa
atgttgaagaacaggttcatttattactctaacaattttcttattccaccgtttagggcttctttctgtcactatctacatcccttcattcctaaatcaaatgattttgatgttaacaatgatgtttcctcattccatcgaatgcttcgtatgcgtcccaccccatccattgtagaatttaacaagattttaggttccattgttaaggctaacaataatcattacaccactgccatttccctttctcatcaattggaactcaaaggaattactccaactattgttactttcaacatattggttaattgttactgccacctaggggaaatgacttttgccttttctatatttgctaagattctcaaattaggttatcaccccacaaccataaccttcaatacacttatcaatggtatttgtcttaacggtaagctcaaggaagctttgcactttcatgaccatgtgattgcacttggatttcacttggatcaagttagttacaggaccttgatcaatgggttgtgtaaaatcggtgaaacaagagccgccttgcaaatgttgaaaaagattgaagggaaattggttaacaccgatgtggtaatgtataatataatcatcaatagtttgtgtaaagataaagctgtaagtgatgcctatcagttatattctgaaatgattacaaagagaatttctcccgatgttgtcactttcaattctctaatcttgggattttgcgttgttggtcaattgaaagaagcatttggtttgttccatgaaatggtattgaaaaatatcaacccagatgtttatactttcagtatattggttgatgctctttgtaaggatggaaatatcacaagagctaagaatatgttagccgttatgatgaaacaaggtgtgattccggatgttgttacctacagttcattaatggatggatattgtctagttaatgaagtgaataaggccaaacatgtgtttagcactatgtctcgactaggagtggctccacatgctcatagctataatataatgattaatggattgggtaagattaaaatggtcgatgaagccttaagtctctttaaggaaatgtgttgcaaaggaattgctcctgatacggtaacttacaattctctcattgatggtttgtgcaaattaggaagaatatcctatgcttggcagcttgttgatgagatgcataataatggtataccagccgacatattaacttacaattctttgatagatgttttatgcaaaaaccatcatattgacaaagctattgcattagttaagaaaattaaagaccagggcattcaaccaagtatgtacacatacaatatacttattgatggactctgtaaaggaggacgacttaagaatgcacaagatgttttccaggatcttttgattaagggttatagtgtaaatgcttggacgtataatattatgatcaatggactttgtaaagaaggcttgtttaatgaagcagaggtcttgttgtccaaaatggagaacaatggtatcattcctgatgctgtaacgtatgaaactatcatccgggctctctttcgtaaagatgagaacgaaaaggcggagaaacttcttcgtgaaatgatcattagaggcctcctattatgcaaacactag

SEQ ID NO: 549 - DNA, 3723 bp, Medicago sativa
atggaggatgatgccgatgccgctgctgccgccgctgccgtgaataacaacaatagggtttcttcgtcaaatccttactggctggatgcctgtgaagatatttctatatcttgtgatgatatcattgattttgatgtttctaatgattctgaccaacaacccaacaacaacaaccaagacttttttggtggtattgatcgaatctttgacagcatcaaaaacggcgctggtctccctgatcatcctcctgcttctgctgctgatgatgggaatcaactacctcctactcatcttcaactagaagaacaacaccaacaggtagaagaagaagaacaagaacaagaaaggttcaacaaaagggctcgcctcaccgaaggagaaaggagaatcaatcatcaacccaacaacaacaacaaggacaggtatgagaggtgtttcaacaataataggaagagaccaaggaataataataatcataatcattcctttaaaagagatgtcaagggttattgggagagggataagtcttctaatgacttggtctttcgctccggaacttgggaacccaatcttcatacttcccaacacaaaatggacatagacaaccccatcaaacaggaaaaacccaaggagactgttcctgttcctgaggaaaaagccagacagtatcagttggatgttcttgagcaggcaaagaccagaaatacaatagcttttctagaaactggagctggcaaaaccctcattgccgttcttctcatcaagtctatacatgagacattacatctccaaaataagaaaatgcttgctgtgtttttggttccaaaagttccacttgtttaccagcaagctgaggtaatccgtgagcgcactggatatcaagtggggcactattgtggagaaatggggcaggatttctgggatgctcgaaggtggcagcgtgaatttgacaccaagcatgttttagtcatgaccgctcaaatacttttgaacattttgaggcatagcatcataaaaatggaagcaatcaatctcctgattcttgatgagtgccatcatgctgtgaagaaacacccatattcgctggtgatgtctgagttctaccatacaacgcccaaagaaaagaggccatctgtatttggaatgactgcttctcctgttaacttaaagggtgtttccagccaagtagactgtgcaataaaaattcgtaatcttgaaagtaagctagattcaatagtttgtaccattaaagatcgtaaagagctagagaaacacgtgcctatgccctctgagattgtggtgaagtatgataaagcggccagtctatgttatttacatgagcaaataaagcagatggagactgaagttgaggaagctgcaaaatctagttcaagaagaagcaaatggcagtttatgggagctagagatgctggagctaaggaagagctgcgccaagtatatggtgtttctgaaagaacagaaagtgatggagctgcaaacctaattcagaagttgagagctgttaattatgcacttggtgaattgggacagtggtgtgcatataaggttgcacaatcttttcttgcagctctgcaaaatgatgaaagggcaaactatcaacttgatgtcaagtttcaggaatcttatctgagtaaagttgtgtctcttctgaaatgtcagctgtcagagggtgccatttctgacaaaaatgatggagtagatgactcacaaaatggtgcagctcacagtgggtctgatgaacatgaagagattgaagaaggagagcttccagacagtcacgttgtctctggtggggagcatgttgatgtcataataggtgctgctgtggctgatggcaaggtgacccccaaggtgcaggctttaatcaaaatactcctcaagtatcagaacacagacgacttccgtgcaatcatctttgttgaacgtgttgtgtctgcattagttctacccaaggtttttgccgagcttccatctcttagttttgtcaagtgtgcaagcttgattggccacaacaatagtcaggaaatgcggacccaccaaatgcatgatacaattgccaagttccgtgatgggcgggtcacgttgttagttgccactagtgttgctgaagaaggtcttgatatccggcaatgtaacgttgttattcgctttgatcttgcgaagactgttctggcatacattcagtctaggggacgtgctagaaagcctgggtctgattacatcctaatggttgagaggggaaatttgtcacatgaagctttcctaaagaatgccaggaacagtgaggaaactttgcggagagaagcaatagagagaacagaccttagtcatctgaaagacagttcaaggttgatttctgtagatacccatccagaaacaatgtaccaggtgaaatctaccggtgcagtagttagcttaaattccgctcttttgtattttgcacttcaaattatgatttgggtgtcttccgatcgtcatccagatattcaattcttcgtcccgagtttattatggagaagcatgaaaactccggaggtcccactgaatattcttgcaggcttcaactgccatgctgtttgtctagctgcttgcagaaaattgcacgaaatgggagcattcactgacatgctattgccggataaaggaagtggggaagaaaaagaaaaggctgagcaaaatgatgaaggggatgcacttccagggactgctagacatagggagttctatcctgaaggtgtggctgacatactgaagggagaatggatcttatctggaaaagatgcttgtaacaactccaaattgcttcatctttatatgtataccataaagtgcgagaatgtaggccattctaaggatccgttcttgactcaggtttcagattttgcagtactttttggcactgaactggatgcagaggtcttatcgatgtcgatggatctatttatcgctcgaaccgtgactacgaaggcgtctcttgtctttagagagtcaatagatatcactgagagtcagttgacgtccctgaaaagctttcatgtaaggttaatgagcattgtcttggatgtggatgttgaaccatctaccactccttgggatcctgcaaaagcatatctgtttgtcccaatggttggcgataagtcttcagatcctatgaaccaaattgactggcatctggttgagacaataattggagccgatgcatggaaaaatcccctccagaaggctcgaccagatgtttaccttggcactaatgagagaactttaggtggtgacagaagggaatacggatttgggaaattgcgtcatggcttggcttttgggcaaaaatcacatccaacctatggaatcagaggagctgtggcccagtttgatgtagtgaaagcttcaggattggttcccaacagagattccatggaaacacaaaatcatatcaatatgactaccaaaggaaaattgatgatggcagatacatgtaccagtccagatgatctagtagggagaattgtaactgctgctcattcagggaagaggttttatgttgattctatacgctatgaaatgacagcagagaactctttccctaggaaagaaggttatcttggtcctctggaatacagttcatatgctgattactacaagcaaaagaagacgaggaagctaatcttagtctgtgaaggaggcatctgttgtcacctgcaatag

SEQ ID NO: 550 - DNA, 1576 bp, Medicago sativa
gggccggggataattatttccatctttaaaaaattctcacttgtgaagtttgaacctgtttcttaatttctcttctatatcttttgttagaaaagaaaaaatgagcaacataagcatggttgaggcaaagctaccaccagggttcagatttcatcctagagatgaagaacttgtgtgtgattacttgatgaagaaggtgacacatagtgattcctttctcatgattgatgttgaccttaacaagtgtgagccatgggatattcctgaagcagcatgtgtgggagggaaagagtggtatttctacacacaaagagatcgtaaatatgcaacaggactacgaacaaatcgtgcaactgcatcaggttattggaaagcaacaggaaaggacagagctatccttcgtaagggcactcttgttggaatgagaaagactttagtgttctatcaaggaagggcacctaaagggagaaaaactgaatgggttatgcatgagtttcgtattgagggtcctcatggccctcctaaaatttcatcttctaaggaagattgggttttgtgtagggtgttctacaaaaacagagaagttgctacaaaacctccaagcatgggtagttgctatgatgacacaggctcttcatcacttccagcattaatggattcttacataagttttgaccaagctcaattccatacagatgaatatgagcaagtgccctgcttctccatgttttctcaaaaccaaaccaacccaatctacaacaatataacaaccaatatggaaccaaaattacctctagccaacaataacaatgcaagtacatttggaggagcaccttatagcttagaccctttatcatgtgatagaaaagtgttaaaagctgttttgagtcaactatcaaagatggaaagaaaccctattaatgatcaaaacctaaaagggtcatcaccaagcttaggtgaaggaagttctgagagttacttatctgaagtgggtatgccccacatgtggaacaatttctaatgtggtatactccactcctatttaattttttttgttgtggctttccctaagttaaagaaattggatcatctccatctacaatgtggtctatgacggtagagaattcaggtccggactgaaaaggaatctgaatcatctatcgttgtaatatggtgctgaagttgtagaggatctaatttcgatgaaaaggcgaacacaatcaaaaataggggtacaaaggagaagagaaaatccattgttttaaatcatgttatagtatctatatatttttctcatggtgttagttattgatatatgaatatctatccacatgatatatatgtcccggtatattagaaagatggggctttgtaattggaacttatgaatttgtagttcattttagttggtggatggagatttttcttcttttgttaaaatagatcattgtgggctagttcaaaagtgaaacaactagatatttagttttaaggtaaaaaaatataatttttctactagaacacaaaaaaagaagcagcagacgagggggctttataatgattgaatagcacacca

SEQ ID NO: 551 - DNA, 1248 bp, Medicago sativa
tcacaaccaccaccttcactttctctcatcttcatcttctcttttatatatcaattcttctctgtttcatcactaaaacctttgatttgaggttttgaacaaggttttagaggttgacccttttggttaccttgatcaagatggaaaacgtttcagtcttatcaaataaggaagatgagaagatggatttgcctcctggatttcgatttcacccaactgatgaagagcttataagtcattacctctacaaaaaggttattgattcaaatttctctgcaagagccattggtgatgtagacctcaacaagtctgaaccttgggatttaccatttaaagcaaaaatgggagaaaaagaatggtactttttctgtgtgagagacagaaaatatccaactgggttgaggacaaacagagcaacagaagcaggttattggaaagcaactgggaaagataaagaaattttcaaagggaaatcgttggttggtatgaagaaaactcttgttttctacaaaggaagagcacctaaaggagaaaaaagtaattgggtcatgcatgaatatcgacttgagggtaaattctctgttcacaatcttccaaaagctgcaaagaatgaatgggtgatttgtagggtttttcagaagagttcagctgggaaaaaaacacatatttctggtataatgagggtggattcacttggtaatgaatttggttgttctgttttaccaccacttactgattcgtcgaattcaattgggaaaatcaaacaattgaatgattcagcttacgtgtcctgcttctccaactcaattgatgttcaaagaaaccaaggaggggatctttgattcattcaacaactcaatttatggtatttcttcacataatcaactagattttttcccaagaatctcatcttctaatggttcattatactctaataatcaagctgcggttaatttgcaatatccaagttctgtttgtggtatgcaagatcaagcaattttaagagctttgtatgaaaacaatggtttcaagactgagagacagcaacaaattatgagtgtgtcacaggaaactgatctaactactgatatgaatgctgaaacatgttctgttgtgtcaaatttggatattggtagaaggacttttgagaataatcagaatcgtccaccacctgcttctgttgcagctgttgattttgatggtaatttgtggaattactaaattgatccaaattaaggagcttttgag

SEQ ID NO: 552 - DNA, 4688 bp, Medicago sativa
cataaaaaaaaacttcatgtttcataaacatgaagatcgtttaaacggtgtcgtttcagttcatgctctgttttaagaaaatcaaaacccaaggaaccagatcgttgttatcacgatgaagtttttcacaaagctctgatctcgaagatttcaacgtgttttcttgtgttcttcactgtctcttctttaggaaacacgtttatttccgtgcttaaacttctttttttacttccaatgaattttttcatcttaaaaaagcacttataattggaatctggatagatagaacaagaaagttctgtggttggtgaaagtgattttgaaaaaagctattatgtcttgtaaagatggtaaaggtgttatggataatggaaaatacgttcgttatacacctgaacaagttgaagctcttgagaggctttatcatgattgtcctaagccaagcagtattcgtcgtcaacagcttattcgagagtgtcctattctctctcatattgaacctaaacagatcaaagtttggttccaaaatagaagggagaagcagagaaaagaggcttcaaggttgcaagctgtgaataggaagttgagtgctatgaataagctgctgatggaagagaatgataggttgcagaaacaaactaatctggcaaccaaagatacaagctgtgattcggcggtgactagtggtcaacgcagtttgacagcccagcatccgccaagggatgcaagtcctgcagggcttttgtccattgcagaggaaactttagcagagtttctttcaaaggctactggaactgctgttgagtgggtccaaatgcctggaatgaagcctggtccggaatctattggaatcattgcgatttctcatggttgccatggtgtggcggcaagagcatgtggcctagtggggctagaacctacaagggttgcagaaatcctcaaagatcggccctcgtggtatcgtgattgccgagctgtggatattctgaacgtgcttcccacagccaatggtggaaccatagagctgctttacatgcagctatatgcgccaactacattggctcctgctcgagacttatggttgttgcgctacacatctgttttagaagatggaagcctagtgatatgtgagaggtctcttaaaaacacacaaaatggtccaagcatgcctcctgtgcagcattttgtcagagctgagatgctgcccagtgggtacctgataaggccttgtgaaggaggtggttccatcatccacattgttgatcatatggatttggagccatggagtgttcccgaggtactgcgtccactctatgaatcatcaacaatgctggctcagaagacaacaatggtggccctacgtcacctaaggcagatttcacatgaagtttctcagtctaacgtcactggatggggtagacgaccagcagcacttcgagcacttggccaaagactgagccggggtttcaatgaggcactcaatgggtttactgatgagggatggtcaatgattggcaatgatggtgttgacgatgttactattctagtgaattcatcccctgacaaattaatgggtctgaatctttcatttgccaatggatttccatctgtcagtaatgcagtcttatgtgctaaagcttcaatgctgttacaaaatgtgcctccggccattctactaaggtttttacgggagcatagatcggagtgggcagacaacaacatggatgcttactcagctgctgccatcaaagctggtccttgtagtttctcaggatctcgggttggaaattatgggggccaagtaattcttcctctagcccacactattgagcacgaggagtttctggaagtcattaaattggaaggaattgcccattctcccgaagacgcgataatgcctagagaagtgtttcttttgcaactctgcagtggaatggatgagaatgctgttggtacctgtgctgaacttatatttgctccaattgatgcatcctttgctgatgatgccccccttctgccttctggatttcgtataattcctcttgattctggaaaggaagtggccaacaacccaaatcgcacccttgacctgacatctgcccttgatattggtcccgctggaaacaaagctgctaatgattgttctggaaattctggctgtatgagatcagtgatgacaatagcatttgaatttgcttttgaaagtcatatgcaagaccatgtagcatctatggcacggcagtatgttcgcagcattatatcgtctgtccaaagggtagcattggcactttcaccttctaatttgaattcacaaggtgggctcaggacaccactgggtactcctgaagctcaaacacttgctcgttggatcagcaacagttataggtgcttcttgggtgctgagctacttaaatctaataatgaggggagcgaatcattactcaagtccttgtggcatcacactgatgcaatactctgctgcactctaaaggcattgcccgtgttcacttttgccaaccaggcagggcttgacatgctggagactaccttagttgctctgcaggatataggcattggagaaaatatttgatgaccatggccgaaagattctgtgctcggaatttcctctaattatacaacagggttttgcatgccttcaaggtggtctttgtctctcaagcatggggagacctatttcatatgaaagagtagtggcttggaaggtcgtccttgctgcgtccattgtcggcaaatctggcaaagtcttagtctctagacaatttgttgatatgtctcggatacgaatcgaaggacttctagcagcatttcccaaattaataggcactggtaaacagcacacatatattgaaaccgacaatgtccgttatgtttaccacccgatagaatctctctatctgcttcttgtaactaacaaacagagcaacatactcgaagatttagatactttgcgacttctctccaaactagtcccagaatattcttattcccttgacgaagaaggtatctgcaagcacgcttttgagttgatttttgcgtttgatgaagttatcgctcttgggcacaaggaaaatgtgactgttgcccaagttaagcaatattgtgagatggaaagtcacgaagagaagctttataagctggttcagcagagtaaggttaatgaaactaaggatcttatgaagcgcaaagctagtgagattgataagagcaagattgaaaagaatagaggtgaaaaaggaggctttggtcctttgacgtcaatgggatctggaagaattgaaaatagcttcagtgatatgagcatatctagctctggaactggtttcggaagtgtctctggttttggattgacaactactgacattgattccttttccaccaagcctaaaggtcgtccaactgcatctgccaatgctccgccaaagggtcttggtatgaagcttggaaaatctcaaaagacaaatcagtttttggaatccttgaaagcagaaggtgaggtcattcttgaagttgatcagccaaaacttggcccgtctcggtcagctgccccaccacttatcgatcccatcactttaactgtggaggagaaactaaacgtgacactgaaaagagatggtggtcttagtaattttgatgttcaaggaacattgtctctccaaattcttaacaaagaggatggacatgttcaagttcaggttcagactggtgagaatcaagccgtctctttcaagacacatcctaacatgaataaagaattatttgccaatgaaaatatattaggtctgaaggatccaaataggcctttccccactggtcaagccagtgatgccggaggtgttggtcttttaaagtggagaatgcaaagcactgatgagtcaatggtgccactgacaatcaactgttggccatcttttctggaaatgaaacttatgtcaacattgaatacgaggcttcatcaatgtttgacctgcggaatgttgtgatctcagtgccccttccagctcttcgtgaggctccatctgttagtcagattgatggggaatggaggtatgactctaggaattccattttggagtggtccgtcctgctgattgataattcaaatcgcagtgggtcgttggagtttgttgttccgcaagtagatgcatcagcattctttcccatctcagttcgttttatggcaactgacacatttagtgacctgaaggttatgaatatcataccagttaagggtggtaatcctcctaaatatgctcagagaacacagttgttaacagaaaactaccaagttgtctgattgattatccttccgactttgtgattctatgacagttttgctttcacagccgtgtctcttttgtcaataggatttacttttagttgcaacatttgctactattcatgaatttatacttttagttctacttgtcaagacaaggagcaaactatgatacttgtatttactattgtggcaagcatcttatgtggaaaaggatgcatttcccatctccctgtttttcttgtgatgaataagaagacaagcaagtcaaatacaaatcgagtacttcatatcccatacatggtagtaaactaactagttgtgcatgtaatgtggtatatttgctaaataatgtttttatttagtttatctttaaaatacatttctcaac

SEQ ID NO: 553 - DNA, 1558 bp, Medicago sativa
atggcctgcaaggatggtaataagcacttaatggataatggaaagtatgtacgttatacacctgagcaggttgaagctcttgaaaggctttatcatgaatgtcctaaaccaagttcaattcgaagacaacaacttattagagaatgtcctattctttctaatattgaaccaagacaaatcaaagtttggtttcagaatagaaggtgtagagagaagcagagaaaagagtctttcaggttgcaaggtgtgaataggaagttgacagccatgaataagctgctgatggaggaaaatgataggttgcagaagcaggtgtctcacctggtgtatgagaatggctattttcgtcaaaacacccaaaatgcaaccaaagacacgagttgtgattcagtggtgactagtggtcagcacaatatgactagtcaacatcccccaagggatgcaagtcctgcagggcttttgtccattgcagaagaaactttagcagaatttctttcaaaggctactggaaccgctgttgagtgggtccaaatgcctggaatgaagcctggtccggattccattggaatcgtcgctatttctcatggttgcactggtgtcgcagacaagagcttgtggtctagtgggactagaacccactagggttgcggaaatcctaaaagatcgtcctttgtggtttcgtgattgccgagctgttgatattgtcaatgtgctgcccactgctaacggtggaactattgagctgctttatatgcagctttatgcaccaaccacattggcacctgctcgtgatttctggttgttacgctacacttctgttgtagaagatggcagcctagtgatctgtgagaggtctcttaaaaatactcaaaatggtccaagcatgcctcctgtgccgcattttgttagagcagacatgctgcctagtgggtacctgataagaccttgtgaaggaggtggttccatcatccacattgttgatcatatggacttggagccatggagcgttccagaagtactgcgtccactatatgaatcaccaatggtgctggctcagaagactactatggcggctttacgtcatctaaggcagatttcgcatgaagtttctcagcccaatgtcactgggtggggaagacgaccagcagctctgcgggcacttagccagagattgagccggggtttcaatgaggcactcaatggatttactgatgaagggtggacaatgatgggcaatgacggtgttgatgatgtcactattctagtaaattcatcacctgacaagttaatgggtctgaatctttcctttggcaatggatttccttctgtcagtaatgctgtgttatgtgccaaggcatcaatgctattacagaatgtgcctccagccattctcctaaggttcctgcgtgaacatagatcagaatgggcggaccataatatggatgcttacacagctgctgccattaaagttggcccttgcagcttaacaggatctcgcgtaggaaattacgggggtcaagtgattctcccgctaacacacactattgagcatgaggag

SEQ ID NO: 554 - DNA, 905 bp, Medicago sativa
  misc_feature (4)..(5): n is a, c, g, or t
  misc_feature (18)..(20): n is a, c, g, or t
  misc_feature (22)..(22): n is a, c, g, or t
  misc_feature (24)..(28): n is a, c, g, or t
  misc_feature (30)..(34): n is a, c, g, or t
  misc_feature (42)..(43): n is a, c, g, or t
  misc_feature (69)..(73): n is a, c, g, or t
gctnnacaatagcagtannncntnnnnngnnnnngcacacanntttacaaatggtccaaaagttgcccnnnnnttttcggccttcttttgcgataatttcaacaatcctgatacaaataataatagtaaacatggaatagacaatacatagtatattcagaatatgcaaggttgatatatagtgctcaaacataagtaacaaatacgcgatagtagtagtagtagtagtaataatagtacgtagttgtcaatttgaccgtaggatctgaaggaatactttgtgatattatctcagtattcaagtgagcctaatgatggtagtccagaaacaatgtcgtgagattctgcaccagtgttgttcatcctttgtccagaacttggaccaagggattctatcgcttcttctcccattttctgaatatcttcaggagaaagtattttgatataccaaacattattgacaaatgattcccacggatcgtctccaaggagaagaacatcgttctccctgtcgacaaatacaagctgccagcctgatctaagaggatcttcaaatttcccctcgattccaaacatctgagccaactcctcccgcagctcgtgatagctgttgaaccgcgagatgtcaagtgagcgccctactgaacctgatttgtataccttcacaaatatcggtgtctggttttgcgcatcaacttgccctgcactttgcaacaactccgatgaatcttgcatgcaaggatatggagaacccctggaaactagactcccccctaacggcattgtcgccgcagccgcatgagcagatgcagtagtataacgagggacagtggtagggagcagaaggcagacgaatcgatattgaccccaaacagaacagaattttgggcatctgagctgcaatg

SEQ ID NO: 555 - DNA, 3352 bp, Medicago sativa
atttttctataactagtaacttcacccaccactcttgttctttttgatcttccatttttccttaaacatacttctcttcttcttgtgagatcctttcacttttcttttcttaagatctatctatttgcttatcaagttttcatctttctcatttttcaccttctgggtcttgtttgctttttcttcttcagattattgctaaatttggttattgtgtgcaatgaagcgtgtagttgaagaatggaacatggggtgttgggggttaaggagaagaatcaatgaggaataaagtgatttttttttgttgtgaaactggttttggttgaggattcaagagtagggaatattaagattttaacgagttttttggttggtgaaagaggggtgtagagtgtaacaaagaatgatattatgtagtagaaagaagaaagagaataatagagttgttttttggtgggagttgtcattttctgcttattttgttgcttaatttgtctacttagagagagtgtttttgattgtgggctcaatttttgagtttacaaatttcttataactttttgttccaatgagactctcttcagctagttttagtcctccaccccaagaaggggaaaagagagttctagattcagaactttggcatgcatgtgctggccctcttgtctctttgccagcagttggaagtagagttgtgtactttccacaaggccacagtgaacaagtggctgtgtcaactaacaaggaagtcgatgcacatatcccaaactatccaagcttacctcctcagcttatttgtcaacttcataatttgactatgcatgctgatgtggagaccgatgaagtgtatgcgcagatgaccttgcaacctctgaatgctcaagagcaaaaagaggcttaccttccagcagagttgggaactccaagtaaacagccgacaaactacttttgcaagaccttgactgctagtgacacaagcactcacgggggattctctgttcctcgccgggcggctgaaaaagtgtttcctcctttggatttctcccaacagcctcctgctcaagagttaatagcaagggacttgcatggtaacgaatggaaattcagacatatcttccgaggccagcccaaaagacatctacttacaactggatggagtgtttttgtgagtgctaaaagacttgttgctggtgattctgtgctgtttatctggcaatgcatcttcttcaataggaatgaaaagaaccaattgcttcttggtattcgccgtgctagccgaccacaaactgtgatgccttcctcagtattgtcaagtgatagtatgcacttgggacttcttgctgcagcagctcatgcggctgcaaccaatagccgtttcactattttctataacccacgtgcgtgtccatccgaatttgtcatacccttggcgaagtatgttaaagctgtgtatcatactcgagtttcagttggtatgcgtttcaggatgctctttgaaacagaggagtctagtgtgcgacgatacatgggtacaataactggcatttgtgacctagattctgtccggtggcctaactcacattggcgctcggtaaaggttggttgggatgaatccactgccggagaaaggcaacctagagtgtctttgtgggaaatcgagccattaacaacgtttcctatgtatccgtcaccattccctcttaggcttaaacgaccatggcctcctggattgccttcgttccatggcatgaaagatgatgattttggcatgagttctcctttgatgtggctccgagacacggatagagggcttcaatctcttaattatcaagggattggggttaatccttggatgcagccaaggtttgatcccgccatgctgaatatgcaaaccgatatgtatcaagctgtggctgctgctgcacttcaggacatgaggactgtagtagatccttccaaacagcttcctggttccttgcttcaatttcagcaaccaccgaacttcccgaacaggaccgctgctttaatgcaggctcagatgttgcaacagtcgcaacctcaacaggcttttcaaaataataatcaggagaatcaaaatctgtcgcaatctcagccacaagctcagactaatcctcaacagcatccacagcatcagcattcattcaataatcaactccatcatcatagccagcagcaacaacaaactcaacagcaagtggtggataataatcagcagatttctggttcggtctctacaatgtctcagtttgtttcagcgactcaacctcaatcaccaccacccatgcaagctctctcttctctatgccatcagcagagtttttctgattcaaatgtgaactcttcaactactattgtttctcctttgcacagtatcatgggttcatcgtttccgcatgatgaatcatccctccttatgagtcttccaagaacaagctcttgggttcctgttcaaaattcaactggttggccatccaaacgcattgcagtggatccactcctctcttcgggagcatctcaatgtattctgcctcaggtggagcagctagggcaggcacggaattcgatgtctcaaaatgctattacattgccaccatttcctggtagggagtgctcaatagaccaagaagggagcaatgatccgcaaagtaatcttttattcggtgtcaatatagatccctcatctcttctactgcataatgggatgtcgaactttaaggggatcagtggcaacaacaatgattcctcaaccatgtcctaccatcaatcttctagttacatgaacaccgcaggcgctgattcttcgttgaatcatggagtaacgcctagtattggtgaatctggtttcttgcatacccaggaaaacggggagcaaggaaacaacccactgaacaagacctttgtgaaggtttataaatcagggtccttcggaagatcgttggatatcactaaattcagcagctacaatgagctgcgtagtgagctcgcccgaatgttcggactggaaggcgagttggaggaccctgtgagatcaggctggcagcttgtattcgttgaccgagagaatgatgttcttctcctcggtgatggcccttggcctgtatggtgcatcacatgcgatctctcttatgacagggaatttgtgaatagtgtatggtgcatcaagatactttcgcctgaggaagtgcagcaaatgggcaacactggcctcgggcttttgaactcggttccaattcaaaggctctcaaatagcatttgtgatgactatgtgagccgtcaagattcaagaaatctaagcagcgggataacaaccgtgggatctctagactactaa

SEQ ID NO: 556 - DNA, 2007 bp, Medicago sativa
atggattgtgatcatgacggacagccaaaacgacaccttcttacaacaggctggagcatatttgttagtgctaagagacttgtagctggagattccgtgcttttcatatggaatgagaagaatcagcttcttttgggaatacgtcgagccaatcgaccgcaaactgtaatgccatcatctgttctatccagtgacagtatgcacattggacttcttgcagccgctgctcatgcttcagcaactaatagctgttttactgtcttctataatccaagggctagtccatctgagtttgtcataccactttcaaaatatatcaaagccgtgtaccatacacgtatttctgttggtatgcgcttcaggatgctctttgagactgaagagtcaagtgtccgcaggtacatgggcacaataacaggcataagtgatctggatgctgttcggtggcagaattctcattggcgctctgtcaaggttggatgggatgaatcaacagcaggagagagacagccacgggtgtcattatgggaaattgagcctttaacaacattcccaatgtatccgtcattgtttcccctcagattgaaacgtccatggcatcctggcacttcatctttgcttgatggtagagacgaagcaacaaatgctctgatgtggatgagaggtggacctgcagaccaaggtctcaattccctaaactttcaaggtgctggtatgttgccctggatgcagcagagactcgatccaactttactcgggaatgatcagaatcaacaataccaagccatgttggcagcagctggaatgcagaacatgggtggtggatatctcatgaggccacaaatggtgaattttcaacaacagcctacccattaccttcaatcaggaaacaataattcacctttgcaacttcaccagccacagtcaattcaacaatcggtgtcctctaatatgatgcagccacaacaaacccaaatacttacagaaaacctgtctcagcaccttcttcagaaaccaaataataatcaagaactccaagctcaacaacagcaacatgcatatcaagatacacttcttgttcaaaatgatcagctccatcagagacaacaacaatccaatgtgccgtcaccgtcatattcaaaaccagatttcctggattcaaacattaagtttcctgcttcagttccctcgggacaaaacatgctcggttcgctttgccctgaaggaactggcaatctcttgaatctatcgagtctaacaagaagtggtcagtcattgatgaatgaacagttaccacaacaatcatggactccaaagtatggaaatatgcaggtcaatgcctttggcagcgcaatgtcacatgcacaatattctggaaaagattcggctatagtgcctccacattgtgattcagatgcccaaaatcatactctctcgggtgtcaatatcgattcatctggtcttctactccccaccactgtcccgaattacactgcttcaacaacggacactggtgcatcaacacaattaggggagtctggattccagggttctctatatgcctgcatgcaagattcatcatttttgcaaaatgcagagcaaatcgacacacaaaaccagaacccaacatttgtgaaggtttacaaatcgggatcggttgggcgttcacttgacatctctaggttcagctgctatcgtgagctgcgagaggagttgggtcaaatgtttggaattgaggggaagttagaagatcctcttagatcaggctggcagcttgtgttcgttgaccgggagaatgatgtgcttctccttggcgacgatccgtgggaatcattcgtgaataacgtttggtatatcaaaatactttcaccggaagatattcagaagatgggagatcaagcagtagaaatgcatggactaggctcgggacaaaggcttaatggcactggtgaatctcaccacattgtttctggacaaccaccatcaattggctcacttgattactga

SEQ ID NO: 557 - DNA, 1966 bp, Medicago sativa
ctttcgtcgttgaagaggctggggatggagtatgtggatcaacgatacaagagattctgaggagtttgtaatcgacgtttaacggatcaaaaccaaagccgtgaacacatgagagaaagtggacgttgccagaacgaggaggaggaatagaaatagggagattaggaatattctgatgtttacggatgttagggttccagaaagcgattccgacattggtggtaatgaagagagagagagagagagagagagagagagagagagagagagagagagagagagcttcaatctcttaattatcaagggattggggttaatccttggatgcagccaaggtttgatcccgccatgctgaatatgcaaaccgatatgtatcaagctgtggctgctgctgcacttcaggacatgaggactgtagtagatccttccaaacagcttcctggttccttgcttcaatttcgcccgccgccgaacttcccgaacaggaccgctgctttaatgcaggctcagatgttgcaacagtcgcaacctcaacaggcttttcaaaataataatcaggagaatcaaaatctgtcgcaatctcagccacaagctcagactaatcctcaacagcatccacagcatcagcattcattcaataatcaactccatcatcatagccagcagcaacaacaaactcaacagcaagtggtggataataatcagcagatttctggttcggtctctacaatgtctcagtttgtttcagcgactcaacctcaatcaccaccacccatgcaagctctctcttctctatgccatcagcagagtttttctgattcaaatgtgaactcttcaactactattgtttctcctttgcacagtatcatgggttcatcgtttccgcatgatgaatcatccctccttatgagtcttccaagaacaagctcttgggttcctgttcaaaattcaactggttggccatccaaacgcattgcagtggatccactcctctcttcgggagcatctcaatgtattctgcctcaggtggagcagctagggcaggcacggaattcgatgtctcaaaatgctattacattgccaccatttcctggtagggagtgctcaatagaccaagaagggagcaatgatccgcaaagtaatcttttattcggtgtcaatatagatccctcatctcttctactgcataatgggatgtcgaactttaaggggatcagtggcaacaacaatgattcctcaaccatgtcctaccatcaatcttctagttacatgaacaccgcaggcgctgattcttcgttgaatcatggagtaacgcctagtattggtgaatctggtttcttgcatacccaggaaaacggggagcaaggaaacaacccactgaacaagacctttgtgaaggtttataaatcagggtccttcggaagatcgttggatatcactaaattcagcagctacaatgagctgcgtagtgagctcgcccgaatgttcggactggaaggcgagttggaggaccctgtgagatcaggctggcagcttgtattcgttgaccgagagaatgatgttcttctcctcggtgatggcccttggccggaatttgtgaatagtgtatggtgcatcaagatactttcgcctgaggaagtgcagcaaatgggcaacactggcctcgggcttttgaactcggttccaattcaaaggctctcaaatagcatttgtgatgactatgtgagccgtcaagattcaagaaatctaagcagcgggataacaaccgtgggatctctagactactaaaagatgtgactgctaatagtctgcatttttttatggaaagtgttatctaaatgtagtttatcttatataatatagccttttatttttatttacatgtttttcatgctaggactattcataaactaatactgtaactatatggtatcttgtcattgtgctagctacaattatatacaat

SEQ ID NO: 558 - DNA, 929 bp, Medicago sativa
gtctaaccttaagagggtcaatagcaacgtgtgactcatcaactgcaccttttcaatcttccacctacttgaataccacaggtgctagattcttcactgaatcctggattgacacacggcgttggtgagtcgggcttcatgcaaactccagaaaatggaggtcaaggaaacccacaaaacaaaacctttgtgaaggtttacaagtcagggtccttcggaagatcgttggatatcaccaaattctccaactaccccgagctacgcagcgagcttgctcgtatgtttgggcttgaaggtgagttggaggaccctgtaagatcaggctggcagcttgtatttgttgatcaagagaatgatgttcttctcctcggtgatggtccatggccggaatttgtaaatagtgtatggtgcatcaagatactttcccctcaggaagtgcagcaaatggggaccaatggtctagagcttctgaactcagctccaacccagaggctctctaatggtatctgtgatgactacactggccgtgaggactcaagaaatttaagcaccgggctaacaactgtggggtctttagactactgaatgttgtgacaacaaatactgtgaatttcttctcttgtattattattactcttctcaaaccctctgtaaagggtgggaagcggttcctagttgtagtttatagcttactcagatataagcctttctttttccagtttttaccgcctaaaacaattattgagctaaacacttagctatatggcatcttctcattgtagtttgtacactatattggtaaccttttggaactctatgtttgaagttacctctatttctacctgtcagtggctaaatcattgagggcatgtattacattacaagactcatgttggaaaaaaaaaaaaaaaaaaaaaaactcgagggcc

SEQ ID NO: 559 - DNA, 709 bp, Medicago sativa
taccatatagttacagtattagtttatgaatagtcctagcatgaaaaacatgtaaataaaaataaaaggctatattatataagataaactacatttagataacactttccataaaaaaatgcagactattagcagtcacatcttttagtagtctagagatcccacggttgttatcccgctgcttagatttcttgaatcttgacggctcacatagtcatcacaaatgctatttgagagcctttgaattggaaccgagttcacaaattccgaggagaagaacatcattctctcggtcaacgaatacaagctgccagcctgatctcacagggtcctccaactcgccttccagtccgaacattcgggcgagctcactacgcagctcattgtagctgctgaatttagtgatatccaacgatcttccgaaggaccctgatttataaaccttcacaaaggtcttgttcagtgggttgtttccttgctccccgttttcctgggtatgcaagaaaccagattcaccaatactaggcgttactccatgattcaacgaagaatcagcgcctgcggtgttcatgtaactagaagattgatggtaggacatggttgaggaatcattggtgttgccactgatccccttaaagttcgacatcccattatgcagtagaagagatgaaggatctatattgacaccgaataaaagattactttgcgg

SEQ ID NO: 560 - DNA, 1869 bp, Medicago sativa
tgtagatgctcaattacatgtagatttgatggagttgtccacaatttctcatatatctattaactaataaccatctaccgaatataattaaccatatattagaatatcattaacctctaaaacagttgtcacgaaagttggttgtacaaaaatcatttctattttttacgccactagttctcttgttatttctctttgttggaaagttgttgtttttaactttgagcttagtcttattaattaacttgtaatggtaacaacatttttctacctccgttcgctggaagtagttactgtgtcaactttagtaattaatttggatcattttggaggcaaaatatggctatgcaacctgtttatcttaaagaacatgaaggaaatgtccacaattctgttggacagttttcatctgtgacttcagcaccatggtggagtaatgcctatggatctcaacctgtttatggaggagactcttgtggccaaatgaaacctttttcactagagctttccaactacatagaccaacttgctccgagtaagaacttagttcgaggagttgaacaattgtttgataaagggcatacaaaccaattcaccatctttccagatgattgtaagatgtcagttgatacaccaaatcatcaagcaaccttatccctgcaatcaccatttgctgccgagccacttaatcgatttgagctaggttttaaccagtctatgatctgtgcaaaatatccgtatatggatcaattttacgggctcttctcgacttatggacctcaaatctcggggcgaattatgcttccgcttagcatgacatctgacgacggaccaacatacgtgaatgctaagcaataccatggaatcatcagacgcaggcattctcgtgccaaagctgtgcttcagaataaattgataaagcgtaacaagccatatatgcacgaatcgcgtcatctacatgcaatgcgtagaccaagaggatgcggtggtcgtttcttgaacacaaaagtttctgctaatggaaacggtaaaagcgggagtgaagagaacggaaacattggtggcctacagctgcagtccagtggttctcagagttccgaagtcttacaatctgaggttggaactttaaattcgtcgaaggagacaaacggaggcagtccaaatgtctcggggtcagaggtgactagcatgtatacacagggagttcttgatagctttactgtcaatcatatcggatctactgtccactctttgggagacatgatcgatactggacacggtatcgtcatgccaacaaaatggtttgcagcagctggcagacagctgctggaaccataagtttcgattcagaaaggaaacaagtgggtttggtacaatgtgaaatattttgcaccaaactcatcctttccgagaccagatgaagaagctatgtttcagtttgttgtgtttactacgacaaatttagtttcggaagactacttttccatctggtgctcaggcaactcattcttggcttattctcaggaaactcatccttggctcgtaatatttagtagtattgtcattgtctttccgcgcaggcttgccgtggcatggtaggcatgctaatgactttggtattttcatgcagttataactatgatgtgtctttgtttgttgttaaaataaaaaacatgaactctagctaggtgcatgtgtgtgtttttaatcttgtctactaagtttggtgttttgtaatggatttctgactttatggagcaatgtattgtaactctactaagaagtgtaacattttatttctccctctctaaggattgtataagaacctcttattttcagactctaaaaaaaaaaaaaaaaaaaactcga

SEQ ID NO: 561 - DNA, 1119 bp, Medicago sativa
cacaattttgtggggcaattatcatctggtactaataattcagttgctgcaccatggtggagtggttttggatctcaatccttttatggagagtctggtggccaaatcaaatccttttcattggagccacctatgtctgttgttgaccaacttgcttcaagtaagcaatctgctagaggaactgaacatgtgtttggaaaagggcataccaatcactttaccatctttccagatgattttaagatgtcaggtgatgcacaaaagcctcatacagccatatcattgcagtcggcagtccctgataccccgaatcgctttgagctgggatttggtcaacctatgatctgtacaaagtatccttatgcagatcaattttatggactcatctcaacctatggacctcaaattcaaggacgtattatgctgccccttaacgtgacatctgatgatggaccgatttatctgaatgctaagcaatacaatggaatcattagacgccggcagtcccgcgccaaagctgtacttggtcacaaattgattaaacgtaacaagccctacatgcacgagtcacgccatctccatgcaatgcggcgaccgagaggatgtggtggtcgtttcttaaacacaaagaaatctgccaatggagatggtaaaactggaagtaaagtgcataaattcggcggtcaacaattgcagttcagtggttctcagagttctgaactccttgaatctgatgttggaactttaaactcttcaaaggaaactaatgggaagcagtccaaatatttctggatcagaggtgactagtttgtattcgaggggaaatcatgacagctttaccgtcgatcaccttggatcttctgtcctctctatggcagacatgatcgatggtgggcgtggtgttatcatgccgaccaaatgggttgcagctggcaactgctgtaaccttaaagcttgattttgtaaagaatcaagtgggtttggtgtgatattgtaccaaaccctgtccttgataagaccagatgactataggctcgtcctgacgtttggtcttaggcaatccatccttggctcattactttggcaaactcatcctggctcattactttggcaaatcat

SEQ ID NO: 562 - DNA, 1599 bp, Medicago sativa
cggccgggggcggcccgcggtgtgtgcgcgtgaaagagagagagagggagagagaagaatcagattagcccctttgaattttcaatttcaatttcaatttcaatcagaatcacaatactaaaaaatctagggttcttttttccttcttcctcagggatctgaggatatgcaacccaagtccgaaactgcaaatcaaccgaggtcaggtcctcattcctttcagcccggtggtgtttactccgaaccttggtggcgtggtgttggatacaatcctgtagcgcaaacaatgtctggtgccaattcatcctctcttgattgtcccaatggtgattcagaatccaatgaggaaggccagtctttgtccaatagtgagaggaatgaggaagatgatgatgctgctaaggattcacagcctgctgctcccaatcaatcaggaaattacggacaagaacaaggaatgcagaatactgcatcatctgcagttattcgcgaagaatgcctcacacagactcctcagctggaacttgttggtcattcaattgcatgtgctacaaatccttatcaggatccatattatggtggcatgatggcagcttatcctcaccagccgttgggatatcctccttttataggagtgcctcatgccagaatgcctttgccccttgagatggctcaagaacctgtttatgtgaatgccaaacaataccaaggaattctgaggcgaagacaagctcgtgctaaagcagagcttgaaaggaagctcataaaatctagaaagccatatcttcatgaatctagacatcagcatgctttgagaagggcaagaggcaccggaggacgatttgcaaagaaaactgatggtgaggcctcgggaaaggataatggctctggtccagtcttgtcgtcgcaatcaattagttcatctggttcagaacttttgccttcagactctgcggaaacctggaattctcccaacatgcgacaagatgcaagaggatcaaatgaaaatggtggtagctcctaccataataacaacaatggtatgcaatcttcaaggtatcagggtgaaagagtggaagaaggggactgttcagggcagctacgtgtaagcatctcctcgaacgaggcatcgcagaggcgtcttgctattcagtagaccccccttcctgcatgggagggatagatgctgaggttggttttgtatatcctagtgatatatttggtgaatgagtaccttaccttggttatcttcttggcaatatatatgccggcaaatcattcttggcttttgttcttgtgtttatggtgtgaatgatataatatgggggggagaagaatggtgattggggtatatgatttctgttgaagtctcaagcaatcaatcaatccttcaatcttatctcatttttgcattttgtacagagttttagtggtagtcaacttcagctgatatggatggtcaggtcagaagactgaagaaaacaaactcttttatgtagtaccaaaactctcttgtttcatggggtttggtctgtaaacttacctgggtgggttgttaatgttaacatgagacatcattataatagaatcaaacatgca

SEQ ID NO: 563 - DNA, 1995 bp, Medicago sativa
atggatgttacttttgttgagaatcaatccttttttgataacattcatcttcaagggggggacttgaaggaagattcttttattgaaaatattattactttaagtgatgtagtgttgtcacaaaattccgagactaacattggtgcaccaaaagaaaatgcccaagaatcgataatggaactcaatccgcttgtgaatgaggtacctacgaattatggggcaacattttcaaatcaaaaccataatgaacaaattcttgatatcgatagtaatgaggaagagcctgaaatgccacaacaaaatgactcaaataaagaaacacaaaacaggttcaatagcagtgatcctatttggaagggaaatgtctatgaaagaagggaccataaaaggggagatgaaggacccattctccagccctgccaagaatctgaaccaagaaatgatcctaatcatcatctaaatcctgttaagtcttctattcctaagtgtcgtggtaagtcttcttctattactacaagtgatgatcctgatttacatatacctatagcaattaggaaaccggttagatcgtgtaccaaacatctgatggctaaatttgtgtcatactcaaatttgtcttcttcatttgctgtgtttacctctcagttgtctattgtagaaattcccaaaaatgtacaggaggctctaaaaattccaaagtggaaggaagctgttctagaggagatgagagctcttgaaaagaataaaacttggaaaatcatgactttacctgcagggaaaaataccgtcggttgtaagtgggtctttacggtaaagtataactctgacaacacagttgaaaggtacaaggcacgcttggttgctaaaggatttactcaggcatatggcatagactactcagagacttttgctcctgttgccaaattaaacactgtcagagttcccttgtccttggcagtgaatttagattggcctcttaaccaacttgatgtaaaaaatgcttttctcaatggtgatttgcaggaagaagtttacatggatagtcctccgggctttgaggacaagtttgggttaaatgtgtgtaaattgcaaaagtctttatatggtctcaagcaatctccaagggcttggttcgaaaaattcacttggtctgtcaaaaaacaaggatatatgcaggctcaatcagatcataccttattcatgcgattttccaatgatggtaagattgccattctaattgtttatgtggataatatcattctcacaggagatgacatagttgagatagatagattgaagaaaaatttggcaaaagaatttgagataaaggacttaggtgcacttaaatactttctcggtatggaggttgcgcattcaagaaagggaattgtagtttctcagagaaaatacatcctagacctcttggaggaaattgggatgagtgggtgtagaccagcagatactcctatggaactaaatgcaaaactctgggagaaaggtaatgttcctgttgacattggacgataccagagattagttggtaagcttatttatttagctcacacgagatctgatattgctttctccgtgagtgttgtcagtcaattcatgcattctccctatgaagaacatctggaggcagtttaccgaatcttaaggtacctgaaatccaaccccagaaacttcaagaaaaccaatgacagagatgtctctatatttacagatgcagattgggcaggatcggttattgacaggaaatctactactggatattgcgcctatgtctggggaaatctagttacttggagaagtaagaaacaaggtgttgttgctcggagtagtgcggaagccgaatttagagccatggctcaaggaatctgcgagctattgtggattcagaaactgttggaagaactaaagttgaaagttgacttacccttaaaattattctgtgacagcaaagcagcaataagtatagctcacaacccggtgtaa

SEQ ID NO: 564 - DNA, 2661 bp, Medicago sativa
cataaattgccattcagttgctaattaagacagtacataatatgtttaattccatcataagtggaaataacaaaacctaaacatagacaaattagcattgaatcataagtcaaggcaaattcaagaaaaaaaagatcaatagaaacagtaatataagttatgaagcacctttgcaagattgttcccttcactctctcagcatctccaagttgaaaccgagatgagatccttcctttgccaacacaagacaagcgaattctgcttcttctccacatggaatcccctaccaggaatcctctgcaccaaacactctgcctgcgactctgtgaagttactaaacgtcaacggcgagaaccctgaggacaatagtaggtttttccaaggaagtgttctatcctgcgaacgcaaacggcccaaaacaagcttctcaattgccggttgaagatagtatttctcgatcatctgaagtacatctgggtggacattgacactaacagcatcaagtgattcaagcaaaccagaataagactggagtgcaaaaaccatatgctgaggaaacggtgcatccgttcgatcacaactcctgtccaatgttacgacaattttaggcatgagctgcttcacaaatcgaagcactaaaggcaggtacgatgggtaatttgagaaagagcaaataggcaagttaaccacaactgcttcacaatcgcgtagtggctgcggccatgaaacagaattcagagactcaagtgtcagaatctcgagctcaaatgacatgttaatttcaccagcatattgcatcagattctcgttagtgaaactgagctcgatttcgtcgtggtgtgagggcgaaacaaatgcagtgatcttgagggcaggtgcaccaccattcctgagtgctaactcctgcataaatgaagaccattgtccaccaaaaccaatatcaaaatctattatatgaattcgatcaaaaccttccacagcttcaagcaatgcttggttggaagtgaaatttgcaaactgcagaacaggtgagatttctgagaatgatttataagcaccaatcttgagcaagaggctagttggtgaaaagctgttgttgttgctgttgttaacatttgattgaagaagcaattgcaatgcctccttaaaataaaaagcagccctttgaaaaggcttccccataggagaaatttggtgattgagccgcgccaatatcccttgcgcgtgttccggattaccggcgtctataagttctgcagccttgaaaagctgatcaattatagcctgctgaaactgatgagccgacacatcttcgccgccaccgcttccagggttccccattttctgcttaggtgccattggcctctgctgcagatggtgaggaagcagttgaagctgctgctgatgttgctgctgctgatgctgttgttgcctcctaagaaacatctcttgacccgaatccaagaagggtatcttcggaatttcataatttgttccacaattgagtcttttagctggaggctgaagctgaatctcttggttttcttgctgctgtgagtatgtgaaaggaaaaaccaaactagggttaggcataaactgagcttggttttggttcataacaaactgatgaggtagcttctgatcaagagacccaattgattgttgttgatgctgatgaaacaaacccaccatgagaaattgaaacttgtgaagaaccggcagccggggtttgaatttgattcatccctctgctaccaaaagggaaatcagtagcagtagcagcagcagcagcagaagaagcagtgctagttacaaagttaattgttgttaccgtttgaagaaataggggtcaaggcacagaacttttgttgatccataaaactaaaaccattgaattcaacatcttgttgagaatgagaattactagttccaacttgtaaaagcttgcttaatcccatagatgcatcttcaatatcttccataatcaattttaaaattgaatgatcttgacttggtgattcagataacacactctcccaatcctccattccacatcttttaccttcaacttgtggtatgtttttgttcgctgcggcaccggtggtgctatcggtagaagcgccgcctccggcgctaccgtgtgaggaagacagtgttgaggatgaactaggagtggtttgttgatttggttttttgaggtcaaaaacaacaacagaattgggctcaatgcccgcatagcaacaattttccctccacctttgcaaaaactgttcttgctgatgtgaaaacaaatatgaatctgaagaagcaacaacacttgaagctaaatctaacacaccttttcctatgtattcttcaaaaggtaagggcatagccttcatctaaatcaacaacaaccaacacaagtttttttttcaaacaataaatcaacaacaacaaaaacaaaattggtttttctgtttttgtataaaaataataaatttaagaaaatataagaaaaaacaagatctgaagttaaggtttttgttgttcctagttcagacaaaaaaacacagttgttgtcaaatgcatgcagctttattgaacaaacccattttcataacaacaataacaacaacaaaaaagacaatacacacacttcaccttcattcattcttcttc

SEQ ID NO: 565 - DNA, 2298 bp, Medicago sativa
atggttcatcacaatccatggaagacgacaacaaccattcctgacctgacgctgaaaacagcttttatgaccaccacaagtagtggcggtccaactcaagaatcagaaacggtaaacaatggtagcagccccatatcgattgtcaccaacaacaacggcagcaccactactggcagcggtggttctggtggtggcggccctggcggtggagatgcactgatgataattagatttacggggaagatgattggcagtgctaaaaagagtggaggactctactaccttgacaatggacccgacttcaaggatcaacctcaacaaataatgttgtcacaaaattccgagactaacattggtgcaccaaaagaaaatgcccaagaatcgataatggaactcaatccgcttgtgaatgaggtacctacgaattatggggcaacattttcaaatcaaaaccataatgaacaaattcttgatatcgatagtaatgaggaagagcctgaaatgccacaacaaaatgactcaaataaagaaacacaaaacaggttcaatagcagtgatcctatttggaagggaaatgtctatgaaagaagggaccataaaaggggagatgaaggacccattctccagccctgccaagaatctgaaccaagaaatgatcctaatcatcatctaaatcctgttaagtcttctattcctaagtgtcgtggtaagtcttcttctattactacaagtgatgatcctgatttacatatacctatagcaattaggaaaccggttagatcgtgtaccaaacatctgatggctaaatttgtgtcatactcaaatttgtcttcttcatttgctgtgtttacctctcagttgtctattgtagaaattcccaaaaatgtacaggaggctctaaaaattccaaagtggaaggaagctgttctagaggagatgagagctcttgaaaagaataaaacttggaaaatcatgactttacctgcagggaaaaataccgtcggttgtaagtgggtctttacggtaaagtataactctgacaacacagttgaaaggtacaaggcacgcttggttgctaaaggatttactcaggcatatggcatagactactcagagacttttgctcctgttgccaaattaaacactgtcagagttcccttgtccttggcagtgaatttagattggcctcttaaccaacttgatgtaaaaaatgcttttctcaatggtgatttgcaggaagaagtttacatggatagtcctccgggctttgaggacaagtttgggttaaatgtgtgtaaattgcaaaagtctttatatggtctcaagcaatctccaagggcttggttcgaaaaattcacttggtctgtcaaaaaacaaggatatatgcaggctcaatcagatcataccttattcatgcgattttccaatgatggtaagattgccattctaattgtttatgtggataatatcattctcacaggagatgacatagttgagatagatagattgaagaaaaatttggcaaaagaatttgagataaaggacttaggtgcacttaaatactttctcggtatggaggttgcgcattcaagaaagggaattgtagtttctcagagaaaatacatcctagacctcttggaggaaattgggatgagtgggtgtagaccagcagatactcctatggaactaaatgcaaaactctgggagaaaggtaatgttcctgttgacattggacgataccagagattagttggtaagcttatttatttagctcacacgagatctgatattgctttctccgtgagtgttgtcagtcaattcatgcattctccctatgaagaacatctggaggcagtttaccgaatcttaaggtacctgaaatccaaccccagaaacttcaagaaaaccaatgacagagatgtctctatatttacagatgcagattgggcaggatcggttattgacaggaaatctactactggatattgcgcctatgtctggggaaatctagttacttggagaagtaagaaacaaggtgttgttgctcggagtagtgcggaagccgaatttagagccatggctcaaggaatctgcgagctattgtggattcagaaactgttggaagaactaaagttgaaagttgacttacccttaaaattattctgtgacagcaaagcagcaataagtatagctcacaacccgcaaactgctgatatcttgacaaagagcttggcaaggcctaattttgagcgacttatagtcaagttgggcatgacaaatatttatggaccaacttga

SEQ ID NO: 566 - DNA, 3402 bp, Medicago sativa
atggctcatcacaatccatggaagacgacaacaaccattcctgacctgatgctgaaaacagcttttatgaccaccacaagtagcggcggtagcggccccataccgattgtcaccaacaacaacggcagcaccactactggcagcggtggttctggtggagatagtcctggtggtggtggcggccctggcggtggaggttctagtggaggtggccctggcggtggcagttttggcggcggtggtccttatggcaacaatgatggttattctaataccctcaagtttgaagttcagcgccttgatggaaaaaattacatggagtggtcccaaaccgtaagactaatactagacggtaagggaaaacttggcttcatcacaggggaaatccaaatgccttcaacaacagatccgaattacagattttggaagtttgagaattcaacaattattgcttggctgctgagcactatggagtcagcaattaagaagccctatatgttcttgccaaccgcaaagaatgtttgggatgctgtcaaagccacatattctgatattcagaattcttctcgaatttttgatctcaaatcacgattgtggcaagccaaacagagtgacagggatgtgaccacttattataatgagttaatggcgttatggcaggaattagatttatgctatgatgataattggaggtgcactgaagacagtgttttgtttctcaagagacaagagaatgatcgagtatttgtgttattggctggtcttaataattgtcttgatgaagtccgaggcagaatacttggaagaatcccattaccaacacttcaggaaactttctcagaagttagaagagaagaagctcgacaaagtgttatgatgggtaagtcggcttctattaccgaaagctcagctttggttaccaagggtaatgaagaaggaaaaagagatggaaagaaaccattctgcaaccattgtaaccgtcaatggcacacctatgatacatgctggaagcttcatggtaaacctccaaactggaagaaaaagggaggaaaggaaggtcgtgctctccaggcaactacttctgatcaggagcatcaatcttcttcaagttcatttcctttcaccaaggaacaattagaccaactgtacaagatgtttgggtctcaaactccttcttgctctatagctcagagaggtaatttccccaatactgctcttgttagtgtcaaacccagtcccacttggattattgattcgggtgctacggatcatatgactggggagtcgagtttgtttgcgtcttatagtccatgtgcagtgctgtcacaaaattctgagactaacattggtgcaccaaaagaaaatgcccaagaatcgataatggaactcaatccgcttgtgaatgaggtacctacgaattctggggcaacattttcaaatcaaaaccataatgaacaaattcttgatatcgatagtaatgaggaagagcctgaaatgccacaacaaaatgactcaaataaagaaacaaaaaacaggttcaatagcagtgatcctatttggaagggaaatgtctatgaaagaagggaccataaaaggggagatgaaggacccattctccagccctgccaagaatctgaaccaagaaatgatcctaatcatcatccaaatcctggtaagtcttctattcctaagtgtcgtggtaagtcttcttctattactacaagtgatgatcctgatttacatatacctatagcaattaggaaaccggttagatcctgtaccaaacatccgatggctaaatttgtgtcatactcaaatttgtcttcttcatttgctgcgtttacctctcagttgtctactgtagaaattcccaaaaatgtacaggaggctctaaaaattccaaagtggaaggaagctgttctagaggagatgagagctcttgaaaagaataaaacttggaaaatcatgactttacctgcagggaaaaataccgtcggctgtaagtgggtctttacggtaaagtataactctgacaacacagttgaaagatacaaggcacgcttggttgctaaaggatttactcaggcatatggcatagactactcagagacttttgctcctgttgccaaattaaacactgtcagagttctcctgtccttggcagtgaatttagattggcctcttaaccaacttgatgtaaaaaatgcttttctcaatggtgatttgcaggaagaagtttacatggatagtcctccgggctttgaggacaagtttgggttaaatgtgtgtaaattgcaaaagtctttatatggtctcaagcaatctccaagggcttggttcgaaaaattcacttggtctgttaaaaaacaaggatatatgcaggctcaatcagatcataccttattcatgcgattttccaatgatggtaaaattgccattctaattgtttatgtggatgatatcattctcacaggagatgacatagttgagatggatagattgaagaaaaatttggcaaaagagtttgagataaaggacttaggtgcacttaagtactttctcggtatggaggttgcgcgttcaagaaagggaattgtagtttctcagagaaaatacatcctagacctcttggaggaaactgggatgagtgggtgtagaccagcagatactcctatggaactaaatgcaaaactctgggagaaaggtaatgttcctgttgacattggacgataccagagattagttggtaagcttatttatttagctcacatgagacctgatattgctttctccgtgagtgttgtcagtcaattcatgcattctccctatgaagaacatctggaggcagtttaccgaatcttaaggtacctgaaatccaaccccggaaaaggcttgtacttcaagaaaaccaatgacagagatgtctctatatttacagatgcagattgggcaggatcagttattgacaggaaatccactactggatattgcgcctatgtctggggaaatctagttacttggagaagtaagaaacaaggtgttgttgctcggagtagtgcggaagccgaatttagagccatggctcaaggaatctgcgagctattgtggattcagaaactgttggaagaactaaagttgaaaattgacttacccttaaaattattctgtgacagcaaagcagcaataagtatagctcacaacccggtgcaacatgacagaaccaagcacattgagattgaccgccacttcataaaagagaaaattgtttctgaaactatttgcctaccgtatgtgacttcaaatgagcaaactgctgatatcctgacaaagagcttggcaaggcctaattttgagcgacttatagtcaagttgggcatgacaaatatttatgcaccaacttga

SEQ ID NO: 567 - DNA, 2346 bp, Medicago sativa
agagaacatagagagagagagaagaagtactttaccacttttatacgcagcacgcatccatcttaacaaaaacacaacacaagaagctacaaagtacaaacaaagagtgttgtgtttgtttgttgttcaaataccagcaaagtgagtttctttcacattcattcatgttcatgtctttcttcttcattcacttcttcaacttcaacatgttacacaacaatacactttaagatgaaggctttgcacttaacttttgaggaatttcaagtgaagggagtgttggataatttctcttcaacttcaaattcagtttcagattcattttcattgcttttgaatcaacctcagcaacaaaattggtcattagataaagaagattattgctatgtggagcccacttctgttcttgattcaagaagaagccctagtcctccattttcatcttcaacaatgtcatcttctcatggtagtggtagtaatggtaatggttcaaacaacaatacttcaatggtaatttctgagaaccttgctcatctttcaaatgatgataatagtgaagaaaaatgtggtggtggtggtatgagaatggaggattgggaaggtcaagatcagtcacttttgaggttaattatgggagatgttgaagacccttctgctggattgaacaaaatcttgcaaaacagtggttatggttctcaaaatgttgattttcatggtggttttggtgttttggatcatcaacaacaacaagggttgacaatgatggatgcttcggttcaacaaggggattacaatgtttttccattcattcctgagaattacaatgtgttaccgcttttggattctggtcaagaagtgtttgctaggagacatcagcagcaggaaacacagcttccattgtttcctcatcattatctgcagcatcaacaacaacaacaacagtcgtcggttgttccatttgcgaagcagcaaaaggtgagttctagtactaccggagatgatgcaagcatccagcttcagcagagtatatttgatcagctatttaaaactgctgagctgatagaagctggtaatccggttcaagcgcaagggatattggcgcggctcaatcaccagctctcaccaattggtaatccttttcaaagggcttctttctacatgaaggaagccttacagttaatgcttcattcaaacggtaacaatctcacggctttttcgccgattagtttcattttcaaaattggagcttataagtctttttccgaaatatcacctgttcttcagtttgccaactttacttgtaatcaatccctcattgaagccttggaaaggttcgatcgaattcatgttattgatttcgatatcgggtttggagtacaatggtcatcttttatgcaagagattgtactaagaagtaacggtaagccttcacttaagattactgctgttgtatcaccctcgtcatgcaacgagattgagctcaatttcacccaagaaaatttgagtcagtatgcaaaagacctcaatatattgtttgagttcaacgttttgaacattgaatcgttgaacttgccgtcgtgtcctctaccgggtcatttctttgatagtaatgaagccattggtgtgaactttcctgtttccagtttcataagtaatccatcatgcttccctgtggctcttcactttttaaagcagctaaggccgaaaattgtcgtaactttggacaaaaactgcgaccgaatggatgtcccgcttcctaccaatgttgttcacgttcttcaatgttactcagctttgcttgaatcacttgatgctgtgaacgtgaacctcgatgtactccaaaagattgaaaggcattacatccaaccaaccatcaacaaaatcgtcctcagtcaccacaaccagcgtgacaaattacctccatggaggaacatgtttcttcagtccggtttctctcccttctcattcagcaacttcacggaagctcaagccgagtgtttggttcaaagggcacctgtgagaggatttcaagtggaaagaaagccttcctctcttgtgctatgctggcagaggaaagaactcatctcagtttcaacttggagatgttgataagtggctaattattaaatgttgaaatttcttaaggtgattggttggtggtaacttttatgttgaagtttatgtaattgtttgtgtaatttttttaggcttatttatgagattcataccctaatgtttgtgaactaaatgggttggtatctatgatttcaaaactctattattagtatgatgtctctttgaacattggtagtagtaattatgtatgcctttcactgtttctcggat

SEQ ID NO: 568 - DNA, 1563 bp, Medicago sativa
gctgagttcattcacgagaacaatgaagtgaagcattttcattttggatccttctctctctttcattctaactaactaaaactcgctttatatatatttttccctccaaatcttcataactgaatcgtaacaaactcaaacctcacaatgttggatctcaatctcaacgctgattcctctcttccactctcctccgtcgttcagatggaagattcatccggtagctttgattcctccgtcgtcaacgctgccgacactgaagattcatgctcttacggcgatgcatacggttacaacttcgccatactcaacaacaacgcttccgtcgacaacagtactatctccggtgaacttcaacattccggcgccggagaagcaggtgtacggacaattcagctttttcctgctaacgaatcgggaatgatctcgccatctgagagtagtggatggatgaatttctcgtccgatcatcacggtggagtaccggagcagactgctgttgttgcttcacgacctcagcaggtgaagaagagtcgtcgtggaccgaggtcacgaagctcgcagtatcgtggtgttactttctaccggagaactggacgttgggaatctcatatttgggattgtggaaaacaagtatacttaggtggatttgataccgcgcatgctgcggcaagagcatatgatcgagctgcgataaagtttcgtggcgtggatgcggatattaatttcaatgtcagtgattatgatgaagatataaagcagatgaataactttacaaaggaagagtttgtgcatattctgcgtagacagagtactggtttctcaaggggaagttctaaatacagaggagttactctgcataaatgtggacgatgggaagctcgtatgggacagtttcttgggaagaagtatatatatcttgggctttttgatagcgagctagatgctgcaagagcgtatgataaggctgctataaaatgcaatggaagggaagcagttacaaattttgaggctagttcttatgaaggagagttaacttcccaggctgataacgatgatatcaagcagaatctggatctgaacttgggtatagctcctccttctaactctgatgttcaaatgatgaacatgcaccacaatggaagtggtttgcaagttcagcgtaactgggatgatatgcctgttgataagagtgtaatgtttgaggactctgggtcaagatcactcaatgttcagtcatcttatggctttcccatagcatctgagcatcaacctccagtctggagtggtactaattactttcccgtgtgtaaggaaagagcaatagagaataggatggaatctgctcccgttccaaattgggcatggcagctccaaagtccatataataatgggtcaactttgattctacctaatttctctgctgcagcatcatcaggattcccttcaacaacagctgcggatagtcaaattcattttccaaacataacatacctccaccctcattttcctacaccagtgactaactccagccccataccctctttctactgcaggagctga

SEQ ID NO: 569 - DNA, 2077 bp, Medicago sativa
ggtttctagagagagagagcgagagagagaacattgaaggtttgctttctgttttgcttgctcaaacttgcctcgtctatgctctattgggcagtttagggttctctcttagatttttcaacatttctctttcttttattaccttcttttattcttcttcttgctaagttaatgtttttcaacctttcttcttcttcttcatattcttgtttatcttgttagatacatatttgagttgagatagagaagaatgtgggatctgaatgactcacctgatcagagaaaaaactatgaatcagaagggtgttcaatggaaggtgatgaagttgatgttgatgaaaaaggaaaaggagttggatctgtttcaaattcaagttcatcagcaatagttatagaagatggatcggaagaagaagatggtaacatgacgaagaaaaagagtagtaagatatttggattttcaatggatgatagtagtgactgtccacctgtgactagacagttttttccggtagaggattctgagacgataacaacggtggtagattcttcttccggtggtggtggtggaagctcttcttttccaagagctcattgggtaggtgtaaaattttgtcaatcagaatctgttaacggtggtaaaatagttgaagcttcacaaccgatgaagaagagtcgtagaggaccaaggtccagaagttctcagtatagaggtgttactttttacagaagaacaggtcgatgggagtctcatatatgggattgtggaaaacaagtgtatttgggtggatttgacacggcacatgcagctgctcgtgcatatgatagagctgcaattaagttcagaggggtagaggcagatataaatttcaacattgaagattatgaagaggatttgaagcagatgagcaatttaacaaaggaagaatttgttcatgtactacggagacaaagcactggatttccaagaggaagttctaaatatagaggtgtgactttgcataaatgtggaagatgggaggctcgaatgggtcaattcttaggcaaaaagtatgtttatctgggtttgtttgacactgagattgaagctgcaagggcatatgataaagcagcaattaaatgcatggtaaagaggctgtcaccaattttgatcccagcatctatgataatgaacttaattctgaatcatcaggtaacgctgcagatcacaatttggatttgagtttgggaaattcaagttctaaatgtagcaataataatcaagcatttgggaatcataacacaaatgccaccactgatcaatacatggcacctgaatcaaattggcggaatggtggaatcagacctaagcctgtgaatatactaccaaaacccatgtggtataaataacatggatggctttgtaagggatgggtatggagagaatgaaaccttgaggatgctaagccaaactcatcttcatcaatcttcaattgccactaatgaaatgcatagatttggtccctataggtcacctatgattgaacaacaccctcaaatgcttcacaattttccacatcttcacccctcaaattttcatgtttcgagcagcagcagcaatggaggccgaatcggaagtgatttaacattatcaatgtctgatcaacaaaaatggcaaacagggcctcctccacatttgttagcaactgctgcagcatcatcaggattcccacctcaaataagaccctcttcttctcaaggttggctgcagaaaaatgggttccacactctcatgagaccctcttgaacaacaacaacattaatatttatttcttcattttcaaccttgccattttaattaatttcacatttaaataatcttatttattgttgagcatgtacaaatgaatgcggtttaattaaattagtacaaaaccataactttaccattgaggtgaaagaagtgataaaagtaagccaaattgggaacactcattggtcttttttctgagtcagtcaaactaacaaacggacgaaatctttaactagatactctatgttatgatctactacatagatattattctggcttctgact

SEQ ID NO: 570 - DNA, 1416 bp, Medicago sativa
atgttagatcttaatctaaacgattcaaactcaactgattcaactcagaatcagaaccataactcgccgatgatttcaaagaactttccgcaaacagtggatgaatcaggaacatcgaattcctcgatcgtcaatgcagacggtgacgaagactcgtgttccacgcgcgatttcactttgagtttcgatattctgaaaacggaaggttcaaattcaaacaacgtcgtaacaaaggagtttttccctgtgaagttgcaagctacgtcgtcgtcattttcgatgaagaacggttcggttgatttttcgattaatcaaaacgaagagatgaagattgttcaagcgccacagcaagtgaagaagagtagaagaggacctaggtctcgtagttcgcaatacagaggtgttacgttttatcgcaggactggtagatgggaatcgcatatctgggattgtgggaaacaagtttatttaggtggatttgacacagctcatgctgctgctagagcctatgatcgagctgctattaagtttaggggaagttggtgctgacataaatttcaatttgaatgattaccgatgatgatcttaaacagacgaagaatttatcaaaagaaggagttcgtgcaaatacttcgtcgacaaagcaatggtttctcaagagggagttcgaagtacaaaggagtaacactgcacaaatgtgggcccgttgggaagctcgaatgggacaattccttgggcaaaagtatatatatccttgggttattcgacagtgaagtagaagctgcaagggcttatgacaaagcagctatccaaaataatggaagggaagcaatgactaattttgaggccagtacatatgaaggagagatgaaatctgcagccatcaatgagggcggcagtcaaaatcttgatctcaatttgggcatagccacgccagggcctagtcccagagaaaattgggggcaacttcacttcccctcatctgtcccttacactatgcaagctggaagaagttcaaagatggaaaccaatgtttcaggaatcggtgatccatctttgaaaaggctattagcaactgaagagcgtcattctttatggaatggcatgtatcccgctttcttttccaatgaggaaagagcagatagcatcaacaaagctcctccaaaaggactccccaattgggcgtggcaacctcatggccttgtcactgctagcccagtgccaccggtctctgcagcagcagcagcatcatcaggattctccattaattcagctcccattccatcgactcgcatgttcccaccaagatctatgaactcaattccccagagtctctattttacttcgcccaatgcacctaacggcaacagatctccatactattatcaggttaagccaccgcaagcaccgacctag

SEQ ID NO: 571 - DNA, 811 bp, Medicago sativa
cggccggggcttcccaacaacaacagttggagatagactacaacagtagtagcagtgggaaacatggttttcttcaaggctcgttagacactgacattgcggatactattaagtcttttttcccagttgaaacgcccaccacatcttttcacaattatcaacaaccgccggatttactctctcgaacggcggcaaccacccagcagcaagatctccgtctctcattgcaatcttttcaagatcctattatgcttcagagccaccatgacaaccaccaccaccaccacaataacaataaccaagtgcttttcgccggaaactcctcccttggttacgacggtggtggaagtggaagcaccttgtggtctgagcagcaacaacagcagcagcatcaagaggaacatgataacggcagattgaatagaatgatggcttggaatgctaataatattaatgctaatgctgcagatggtggtaacagtggccatggtgctggatttgtgttcagtacaccggcaccggcgtttggcggttatggtcagttttttactcagaggggaccccttcagtccagttacaatccttcagttcgtgcttggatagatccttcaatggcgacggcgaatatcgttgatcaccatcatcactatctttcgccgatgatccatcaggcttctgtctctggtggtggattctcacgctttcgtataccagcacgaattcagggtgaagaggaacacgacggcgtatccgataaaccgtcctctgcttcctccgactctcgccattgattggaacactgataaaaata

SEQ ID NO: 572 - DNA, 1371 bp, Medicago sativa
atgggaatgaagagcacaggaggagaaatagttcaagttcaaggaggccacattgtaagggcgacaggtagaaaagacagacatagtaaggtatacactgcgaaaggtcctcgtgatcgacgtgttcgattatcagcacacacagcaattcaattctatgatgttcaagaccgtctcggctacgacagaccgagtaaagctgttgattggcttatcaaaaaggctaagtctgccattgacaaacttgatcagcttccaccatggaatccaattccaaatgcaacagaagagttacaagaggaagagaataataataataatgcagtagaaacaaatgaaatggttattgcagcagaacaatcagaatcttctggttacaatttgcagcagaacaatcatcataaccataaccattcaggtttcattcaatcaactattgataatgatgctatagcattttttccaacaacttctgttggtgaatctatgaattttcaaagctactcttctgatataatctcaagaacaaacaactcaacacaggatcttggtctttctcttcattcattccaagacaattcagcttcaaatgatcaaacacttttctctggatcaaatcctgttggatttgatgctaattataacaggattgtgaattggaacacagctgatatgaatagaaccgggtttatggttaattcgcctgcgtttcttggccaaggttcgactttttccgcccatagggggacccttcagtccagtttttcgccatcacttcgtccttggaatgatattccaattgcggatgcctcggtggatcatcataatcacaagtctcaacaacaaattcaccaagcttctatcttcggtagcaggtttctgtctgatgctttgacaggtttctgtattcctgctagaattcaaggtgatgttccgttgtgtaggaggtttaaccgtttatttggcttagctttgaataagctgagtacagtgtctgatatgttcactcttggttgggaggtaggaggagatgcgtggagttggaggagaccgttgtgggcgtgggaggaggagatgttaagcgagtgtcgccttttacttaacaattttgttgtgcatactgatgtttttgacaggtggcaatggctcccggatattgtgggaggctatacagtgcgtggttcccttgaaggtgtctattcttgcttggagattgcttcaagacaggctgcccacgaaaatcaatcttctaaggcggggcgttcttccttctcaggctatcacgtgtgtggcggggagggtctacaaggcgccggtcataacatttatgcagatgctttggttactgtttgtgtggatagtttggaatga

SEQ ID NO: 573 - DNA, 3583 bp, Medicago sativa
gactcactatagggcgaattgggtaccgggccccccctcgagttttttttttttttttaaagaagtgaaatggcgtctaatatttatgtataataaaaactagcaaagtgcaagaatacaacaaagtacaaaccactaaatatccggaggggactaaaattgctttaatcagtcagcctaaacaaagtacaaacagcttaataaataagaaaaaattaaataaaactgaacctaaaatgcacctacagagtccatacatagtctggtgcatcctcccttttcccagccactgtacgatacaaatacatctttcgtctgaaaactctctgtccccatcttccacgtaacaatctgcctgttcactttcactgaaaatctccacattcaacctcggcatcttctttgccagtgtcttgcatgcttctacagtcacctcgcacgacgacatccaaagggatcgcattgtttcatacttccctatgtctgttagaagcgccgtgtctccgaaaggacagtctctaatctcaagcttgcgaatctttttgcatccgttcaatacatagagcattcccttgtcactctcgccagcaaatgcaatagataacatttcaagctgctcaggcatacataccaatgtaaaggaaaacctggtcggtcaactgacctgagagtgatagccgcctcagtcgcttgcatgactgcacaatcgccccaaaaccttcatctagtggctgcattgtgtcagggtcaggttttgttgcatccaggatgcataacctaaatcggataaaatttgggcagtttttggccactgctatgagagcagcattggtcatctggtgacagaagtagagtaatgagtgaagcttaggacatcccattgatatcgctacaagtcctttttcggtaacagctgcttggtttccaaatggagctgatgggaaaactcttaattcttgcaattctttacatggtgctagctacaacacctagtcccaagtctccaatgcgatccattatccataagcgctggtagtttcccacagtgggcggataagttttatgagctcaatgcccagaatgcctgcggcatagctcaagttcaaggatggttaagttctggcaaattggataaatagctgcaaggctaaaaggagccacttccaaaaaccctgacaaactggttattgacttgcacttgagaatggtggccttaaacatagcataggcatctgaattgagatcatggaaaaatgatccaattcctaaatccattagttgaggtgctcgcgttagtatcctttgcagtgcatcgacaggcacagatcctgtttaaccttagactcttaaggttaggagatcttgacacaagtctctcaagtgctcccaaattaatatctcctttaaggcaagcgaaattaagagagacaagtgaggtgcaactctctggaaagcaacttagccactgtcctttgtgatcttcaacttcattctcttgcaggtctagctccctaagagacctgcaattagcacgcaacagcagcaaggccatcagtggtgaacccttcacagctaccaagaactaaagacttaaaattcacaaaagaacgagaaagtagctcaaggctctcatttgacacaaccatcctcttcaacctaagttcctccaaaccacaccttattcttagcaagtgcttcaatccatggataaacaaaaccaccccaaccatgaggaaccaaactaaaatcagcaaaatgaggttttcccttcaaagttaaagatttcagatcaggaaacctctccaccaacctctcaggactaatagagtaacagtttcctatgaacaccctttgtcttgtaaatctctctattctataccaacttttgcataccaaagacaaagagtttctgtcactatgtgaaaccacatagtcaaaaacatgttctattacctcgtctggaaaataattcatgttttttttctctctcactcggctcaagagatccaaatttcacaacttttgtggaaaattttcattctctctcaacaataaaaacaaagatagaaaacacgtggaattacccaagatctaaacaaacacagagatacccttatgaaattaaagtggaaaaaacggatctttactcaaatctagaacatgatgaaagatctagaagaacaaaaggtgaaaataatttaaagggtactaataaaaattgtaaaaattacatttttcagcgtggatctgcatgttagttacaaaattaacgcaaaatttctcgagaaaatacagttgcagatgaaaaaaaattaaaaattgtgatgatgaaattggattctgaaagaagcaaatttgaatttagatagaatatagatctaagaaaatctaagcctttgcagaaacaataattaacattattagaacacaacccagaagaagagatgagttgagaaagtgctcgtgccgaattcggcaccagtattggagctgcagtggctgcaatttaccaccaatacattctaagaggatcagccattaaagctcttggatccttcaggagtaacgcttaattaaattaagctagctcaattgctttatttgccaaccaagctatgatgttaatttctccaaaagaataatgttgaagagtgcaaattaagtggtcctatcttggccttttcgtcttttccttttcagctgcagctgtattggggtttggaggaaaaaaaaaaccaataacatggggccatgcaattgtagataaccttgcttgtgtttcaagggtgtattttgtatcccttttgtgtctttttttcatttttattttcaatgtatgtattcaattcctatgtgttccctttattttctgttttgtgaatcctttgtcctttttcaaatttctcttgataattaagtgccatatttatcatccatccttgttgtgaatttcgtatcaaaatttgtttgtttcttaaagttttataaattatcatcatattctttcaaaaaaaaaaaaacggcaccagcaaggatgaagtgtgtttgtcttgagtgttattgcattttaaataaactttttgtgatgaatgtgtttaatacagtattggtatacttctaattttgggattgagattccttgctgccaaggggtcccacattcatacattgtgaagatcgatagtttttcgatgaagatcagatagtccataaaatgcaagtcttatggtttattttatgattaagacatcaaatttgaatcttgattgttcgatccagatcaaacaaccaccgatgttccaattgtgtgaatacggagaaatattcatatcgtggtaattggagacagaaaaggagtttactcttatgttgttttatgttttttcagtcacaaacatgcttgtttctttcaacaaagtcactcattctagtttgtgatggaatagagtcttgctgatttgatatattgtcatttgatgtgtataaatggctactgtgtgcttgtaaaatgtttgatttaaataaaagattgctctagctcttaaaaaaaaaaaaaaaaaactcgaggggggggccggtacgc

SEQ ID NO: 574 - DNA, 800 bp, Medicago sativa
ggctttctgtggcttttgctggagatagtgatctgggactccatcacgtgctgtctgggtgtgacaaccttaggaagctggagatcagggactgcccctttggtgacaaagctcttttagccaacgctgcaaagttggagacaatgcgatccctttggatgtcctcttgctcagtgagttatggagcatgtaaactgttgggtcagaagttgcctaggctcaatgttgaagtcattgatgaaagaggacctccaaatttaaggccagatagtaatcctgtggagaaactatatatatacaggactatttctgggcctagattggacatgccgcggtgggtatggacaatggaagatgattctgcatatcttgaatgactgtactcctcaataatgaacatttgatgtgtgacttggtgatggcaggtacaggctcaacgtaccctacaatgaatttaatctgttgaccgtcctatgctgctgttatggttggtttctgagctaggtacagcaaggaggttatacagtgtacttagaaagcttgagctcgattgccattcaatttttacttttggctgagcgactagataccgattctgatcacaaataaaaccggaaatttgttgttgtatgtggcataagattgagttgttaaaacttgttatataatttattttcgcctttttatttcaaggacttctgcataatttttatgcatgatacttttggtcgagtattaagatattggtgggctcattgttattattgacctttgcaaaggaataaaatctgtattctagt

SEQ ID NO: 575 - DNA, 1717 bp, Medicago sativa
ctacagagtccatacatagtctggtgcatcctcccttttcccagccactgtacgatacaaatacatcttctcgactctctgcccatcttccacgtaacaatctgcctgttcactttcactgaaaatctccacattcaacctcgggcatcttcttagccagtgtcttgcatgcttctacagtcacctcgcacgacgacatccaaagggatcgcattgtttcatacttccctatgtctgttagaagcgccgtgtctccgaaaggacagtctctaatctcaagcttgcgaatctttttgcatccgttcaatacatagagcattcccttgtcactctcgccagcaaatgcaatagataacatttcaagctgctcagcatacataccaatgtaaaggaaaacctggtcggtcaactgacctgagagtgatagccgcctcagtcgcttgcatgactgcacaatcgccccaaaaccttcatctagtggctgcattgtgtcagggtcaggttttgttgcatccaggatgcataacctaaatcggataaaatttgggcagtttttggccactgctatgagagcagcattggtcatctggtgacagaagtagagtaatgagtgaagcttaggacatcccattgatatcgctacaagtcctttttcggtaacagctgcttggtttccaaatggagctgatgggaaaactcttaattcttgcaattctttacatgtgctagctacaacacctagtcccaagtctccaatgcgatccattatccataagcgctgtagtttcccacagtggcggataagttttatgagctcaatgcccagaatgcctgcggcatagctcaagttcaaggatgttaagttctggcaaattggataaatagctgcaaggctaaaaggagccacttccaaaaaccctgacaaactggttattgacttgcacttgagaatggtggccttaaacatagcataggcatctgaattgagatcatggaaaaatgatccaattcctaaatccattagttgaggtgctcgcgttagtatcctttgcagtgcatcgacaggcacagatctgtttaaccttagactcttaaggttaggagatcttgacacaagtctctcaagtgctcccaaattaatatctcctttaaggcaagcgaaattaagagagacaagtgaggtgcaactctctggaaagcaacttagccactgtcctttgtgatcttcaacttcattctcttgcaggtctagctccctaagagacctgcaattagcagcaacagcagcaaggccatcagtggtgaacccttcacagctaacaagaactaaagacttaaaattcacaaaagaacgagaaagtagctcaaggctctcatctgacacaaccatcctcttcaacctaagttcctccaaaccaaccttattcttagcaagtgcttcaatccatggataaacaaaaccaccccaaccatgaggaaccaaactaaaatcagcaaaatgaggttttcccttcaaagttaaagatttcagatcaggaaacctctccaccaacctctcaggactaatagagtaacagtttcctatgaacaccctttgtcttgtaaatctctctattctataccaacttttgcataccaaagacaaagagtttctgtcactatgtgaaaccacatagtcaaaaacatgttctattacctcgtctggaaaataattcat

SEQ ID NO: 576 - DNA, 685 bp, Medicago sativa
tcaaagctggtttatctgttcctcctgacctccttttacctattacggaaaagtcttcaattcatgtctcatccatctctgggttattatgcgaaaaaaaattgacccagaaccaggtaggtgtagaagaacagatggtaaaaaatggagatgtgctagggatgctcatcctgattctaagtactgtgaccggcatatgattcgacgtcgttaccgttcaagaaagcctgtggaatcttcttcttcttcttcttgttcacaatcttcatcttcagtttcagctactacttcacaaggtggttctagtggaagtactagtactgtttctgcttctgttactgctacttcaacttttcaaacacttcctttgcatacaaatggtactcgtgaaggtttaagtttcaatcttgggaacaccgtgccccacatggaccctatgcttcttcctcttcagggttctaagaaaccttataggtttggactgaactcggaagcagaggagaacaacctcttacagaaagatctaggatctgtgaagtatcgaggttatgacttcacttcagatggcatgtggtataataacatgtctcagatttcatcatacactgtttcagaatcaaggaatggttcttccatggttgacaactactacttccaacagcgaacaacaagagaacctgagctg

SEQ ID NO: 577 - DNA, 1515 bp, Medicago sativa
cttcaccttcacatcttctctctctctatctctactaattcacttctgaaccttttcatttcaatcctaactcctttttctacatagttcattttactttttcattcaaaagtgatcatcatcatcagtatcaaaaagaaaaagctcatgcatatgttgacaatggaagctaaacctcttcaacttgttccctcttcacacaacagcacaactggtggtggaccccagatgaagattgagaatggtgaagttgatgaagagaaaagggttgttgttggagtgaaggaagatatagaaaacaagcctttgatcacagaagctcaaaggcgtgaacttgatcatcaagtttttatttttaatcattttgcttataatcttcctcttccttattaccttttgcaatttccaagtaatatgtcagagtacagtcgtcgtgggtctgattatgtgactatggtggatcaagaaccacataggtgtagaagaactgacggaaagaaatggaggtgcggcaaggacacagtacctaatcagaagtattgtgaacgtcacatgcacagaggtcgaaatcgttcaagaaagcttgtggaaacatctcaacttaactctcctttgaaaacaaatcctagtggtggtggcaagtcacatgcaaaactagtcccaaacattaaatcttcagtttcaaatccaaaccctttgattattcatcacaatggcacattctcatacaatccgaggaccttctgcgttgtagatacttcttctgtttgtgatcggtcgagacatgtcatagattatggtgccactgcagtgacaacttcgggaagcacgacatccgtttctttggataacagagtttgtcctaacgtatgcaagcaagatgagcagatcaagaggtgtatcaccgacaacgtgggtattaaaagtggtcggaaaggaagcatatcttgtgaaagtattggcatctctactggaataggcttttccccaaagagtgttcttccagccgttcataaaaaggctagggtagtggggaggcagaggcatctaagtggtcggcctagcattgaggtttctggttgcaatgattcatacctcaacaacagaaacaatatattagaacctgaacccggtagatgccgaagaacagatggtaagaagtggcgatgcaagagtgcggttcttccaggtcagaagtattgtgcaacacatatgcatagaggtgctaaaaggcgttttacaaacctcgaatctcctcctcctgccaccactgttattcctaaaactactgatattagttcagctgttaccattgctcagttgcccgacccttcggctccaatcgacatccagaaagcgaattgttggtctccgagcactaagctttcaatgtcggttcaagaaagtgcgccctttgttgattgtaatgagaaaagtgttagcagcggtgacacggatggtactagtaccaccatcactgacaccatgaatgagtgtagctatctttctttctaa

SEQ ID NO: 578 - DNA, 710 bp, Medicago sativa
tcccggcacacaattaacaccaaaccaaaacggaccaaatggttccttccgacaaagctcgatctgagtctggtctctgactgaacaacaactacaagtgtatgttgtgttagctagatagatagatagatacactattgattcactcactcactgagagttacagtacaaagcagttagaaaaagtatgaatagctctgggggtggcagtagtaacggaggaggtgtagggatgatgatgggttacagtaaatcatcaccattcacagtgtctcagtggcaggaacttgaacatcaagctttgatctttaaatatatggttgctggtcttcctgttccacctgatcttgtccatcctattcattccagctttcactctctttcttctaataatttctttcaccaccctattcctaccttgagttactgttccttctatgggaagaaggtggacccggagccaggaagatgtaggaggactgatggaaaaaagtggaggtgctcgaaggaagcatacccagactccaagtactgtgagcgccacatgcaccgtggccgcaaccgttcaagaaagcctgtggaatcacaaactatggcacagtcgacatccactgtgacatcgctgactgtcgctggtggcagcagcagagctggtaacttccagaacattcccacaacaaatgcatttggtagtgttcaaaatactacag

SEQ ID NO: 579 - DNA, 1972 bp, Medicago sativa
gcacgagaacaaattttgtcacaacaatgaagactatcttatgctacttacttggtttacttactatcattgtttcatttgcttcagctgcagagaatcattaccatcagtttgttattcaaactgcaacagtgaagaggctgtgcaaaactcgaaggatactcacggtaaatggacagtttcctggtccaacgatcgaagctagagacggagattctatggtgatcaaagtaacaaatgctggaccttacaacatctccatccactggcatgggtttaggatgttgagaaatccatgggcagatggacctagttatgtgactcaatgtccaatccaaccaggaggaagttacacataccgctttacgattcaaaaccaagaaggaacactatggtggcatgctcacactggtttcctaagagctactgtctatggagctttcattatttatccgaaaatgggttctccttatcctttctctatgccaactagagaatttcctattcttcttggggaatggtttgatagagatccaatggctctcttaagacaaacacagttcacaggagcacctccaaatgtatctgttgcatacaccatgaatggtcaaccgggagatctctacagatgttccagtcaaggaaccgtacgttttcaagtgtatgcaggagaaacaattctcttaagaatcatcaacagtgcactcaatcaagaactcttcttttcaattgctaaccatagaaatgactgttgttgctatggatgctgcttacacaaaaccttccaacactagagtcctcatgataggaccaggtcaaacaatcaatgtccttgtcacagccgaccaaccaccaggccgatactacatggcagcacgcgcttaccaaaccgccatgaatgctgcatttgacaacacaacaactactgcaattcttgaatacagaaatagaccaccttcaagacctattttgccagttttaccgttttttaacgacacggccacttcaactgcattcacatcacggattagaggtctttccaaaattaaagtgtttcaaaatgttgatgtgagtttattgttcactgtagggttagggttaataaactgcacaaatcctaatagtccaaggtgtcaaggaccaaatggaacaagatttgcagctagtataaacaacaactcttttgttcttcctagaacaacctccttaatgcaagcttactataatggtgttcctggtatttttaccacagattttcctcctgttcctcctatacagttcaattacacaggaaatgttcctaggggtttgtggacacctagaaaaggaaccaagttgttcaagttgaaatatggttccaatgttcagattgttttgcaggatactagtattgtaacagttgaggatcaccctatgcatgttcatgggttccatttctttgtagttggttcaggttttggaaattttaatccaaggactgatcctgctacgtttaaccttgtcgatccacctgtgaggaatactattggaacacctcctggtggatgggtggccattcgtttcaaggccgataatccaggaatttggttcttgcattgtcacatagattcacatctcaattggggtttgggaacagcacttttggtagaaaatggagttggcccattacagtcagtgatacctccaccaccagatctacctcaatgctaaaagcatcattaatcctaaattatgtcactgaattattttactcaattattgctctttttaaatacttaccttatagattgtatttctttttgtgattttcaaggtccataattgtaccaaggtcaattgggacttgagtagtttatttgttgtttttgtctttcttgattgggttgtaactttttaagatttttaaagggaaaaaaaaagtgtgatttctcattagtaatattaagagtttattaaaaaaaaaaaaaaaaaa

SEQ ID NO: 580 - DNA, 2103 bp, Medicago sativa
acgcggggattttaagtgtaatcataagctatctgctgatttatcctacaagttggtcacttcaagatgaatattttgttgtggcaaacatgggcttttgctctaattttatcttcatttatggcttctgctgctacagttgaacacactttcttggttgaaaacaagactatcaaacgattatgcaatgaacaagtgattgttacagttaatggactttacccaggtccaaagctagaggtcagagatggtgactctgtgattgttcatgtaatcaacaattcaccctacaatataacaattcactggcatggagtgttccagctatatagtgcatggtcagatggacctgaatatataacacaatgttcaattcgtcctgaaaataaatttacatacaaatttaatgtgacacaacaagaaggaacattatggtggcatgctcatgcatcagttgtacgtgcaacagttcacggtgccattatcattcaacctcgttctggtcgatttccatttcctaaaccttacaaggaagtaccaataatactaggtgattggtatgatggaaatgttgaggagattatccaaaaagaactcgaaacaggcgataaaatagcatctgatgctttcactatcaacggctttcctggcgatctcttcaattgttcaaaaaatcagatgtataagctgaaagtgaagcaaggaaagacctatttgttccgaatggtcaacgctgcactcgctaacaatcttttcttcaagattgccgatcacaaattcacagttgtagccatggatgccgcatacaccgagccctataccaccgatataatcgtcatcgcggcaggccaaagcgctgatatacttttcacagcagaccaaccaaaaggttcatactacatggctgcatcaccttatgttgttggtgaaccagtaggactcttcgacaattccacaactcgtgccgtcgtcttttacgagggttacaaaaaattaaaaacaaaacatatagtacctttaatgccagcattaccacttcataacaatacaccaatagctcacaaatttttcagcaacataactggtcttgtagggggtcctaattgggtccctgtcccacttgaagtggatgaacacatgtatatcacaattaacatgggtttagtaccttgtcctgtaaatgctaagtgtacaggtccacttggacaaaaatttgcatctagcatgaacaatgagtcatttttgcttcctgttggaaaaggatattccataatggaagcatatttttacaatgtgagtggcatttacactacagattttccagataaccctccaaaatttttcgacttcgtaaacccgaaaatatttttggatcctaatgttacatttacaccgaaatcgactaaggtgaagcaattcaaatacaattcaacggtggagattgtgtttcaaaatacagcgattttgaatgcgcaaagtcatcccatgcatcttcatggtatgaattttcatgttttggcgcaagacttcgggattttcaatcctactactgataaactcaagtataatttggtgaatccttcaattcgcaacacggttgctgtgccggtgggaggatgggctgctattagattccgaacaaacaatcctggggtatggtttttgcattgtcatgtggatgatcataatctttggggattagtcacagcattcatagttgaaaatggaccaacgccttcaacttcacttggtccaccacctgctgatttgcctaaatgttaattggctatatgctagaaaatgcagctgtatattttagaagtcaaagtctcctctttcatatttttcttttgattattcagtcaaacgttttaattttaaatttcaagcaataagtacaacttttggtcacgtggtaggatgaaaattgtacccatatctacaatatacaacttttggtcatgtggtaatcatatccatgggtatctagtaagtgaaattaccagagtcttacattgatgctataattgattagtcgcctggggacactgaaagctgttttttgatgaatagtgtgatgtttaattctgcaattatgtcccc

SEQ ID NO: 581 - DNA, 879 bp, Medicago sativa
ggcacgaggtcatacttttggtaagttgaataaactcgagaaggtttctgagcttcttagggaaatggagtcaggtggtagtttgccggatgttagttcttataatgttctgttggaggcttatgcgagatatggggtttattaaggagtctattggggtgtttaggcagatgcaggaggcggggtgtgtgccaaattcggctacttatagtattttgttgaacttgtatgggaaacatgggaggtatgatgatgttcgcgatctttttcttgaaatgaaagtgagcaacacggatccggatgctggtacttataatattcttatacaggtgtttggggaggggggatactttaaggaggttgtcactttgtttcatgatatggtggatgaaaatattgagcctaacatggagacttatgaaggtttgatatttgcttgtgggaagggagggctttttgaagatgctaagaaaattttacttcatatgaatgaaaagggtattgttccgagttcaaaggcttataccggtgtgattgaagcttatgggcaggcagctttgtatgaagaggctctggttgcgtttaacactatgaatgaagttggaagcaccccaactgttgagacctacaattcgctcgtttgttccttttcaagggggggattgtacaaagaggttgaagcaattttatttaggatgagtgagtctggtttaccgcgggacgtgcattcgttcaatggtgtaattgaagctttaaggcaagcaggtcaatattgaagaggctgtaaaagctcatgttgagatggaaaaagcaaactgtgatcctaatgagtcgacatttgaagcagtattaagcatatactgctccggcaaggtcttg

SEQ ID NO: 582 - DNA, 3879 bp, Medicago sativa
atgagtgggagatatcaccgcaacaaatcacaacaacaacatcgtaccaaatcgaaacttcgctacgttaacaaatccgaactaattgtttcttcacctaactctgtggcggttgaacaaccagtttcctctgaggatgttattgtcaacaacaacaacaacaccgttgatgacgtggccagttcaagcaagaccaagaccaaggaagaatatgattatgataataacgatattgataatggtatggataatactaataggcttgataagttgcttactgatattcaacaaattgaattatccgaggaagagatcacaatcaatgatcaattgcagcaagatgagggaggaagtgaacgggaggcaagccttagaagcggcttgagtagaagcaagacggagtatatggaatgtaacttcagcggaaggagaagtagctctaccttggaggtaaaagttggagatcatatcataccccaagttacacggtttaaatatcttgggtccttcgtacaaaatgacggagaaatagaagcagatgtaagccatcgtattcaagctgggtggttgaaatggagaagagcctcaggtgttttgtgcaataagaaagtaccacttaagttgaaaggaaagttctatcggacagcagtccgaccggctttgttgtatggtacggagtgttgggcggttaagagtcaacatgagaatcaagtaagtgtagcagagatgaggatgttacgttggatgagtgagagaagacccgtagatgccgtgttaagaagagtagatcaaatggaggagagtcaagttaaaagaggtagaggaagacctaggaaaactattagagaaaccattagaaaggatttagagttacttgtggtggaatcaatttatggagaaaacgttttcagccttgatacatggaaaggcctgcgttgttttcagatacacataaacattgatgttttgggtgaaataggcattactgccaaggttaactctgttaatgaacttgagacattaagcaacaattcagacgatttcttatactctttcaaagttcaatatcttccaccgattgttttgacatgtttattacctaagtcatatccgagtcaccaaccgcctatatttacaatctctgtcaagtggctggaatctgcgaagattttaagtttatgttccaagttggattcaatatggacagaacaacaagggcaggaagtgatttacagttgggtagaatggttacaaaattcttctctttctcatttgggatttgatgaggagattagattaggtccttatggttggaatcgtgttgcggatgcacgcgtggtttcgggaattggatgcattgatgctgatattccttttttacaaagctacaacaatgagagacgccatcaaaacttccttaaagaattgcatgaatgctgtgtttgctatagtgaatatccaggaaacgttagtaatcttcaatgtcttgatgcaaaatgcaaggagatgattccaccaggccttttaaaacactttcttggtgatgaagaatacgaacgttgggaatctatgatgttagagaaaacacttgcatcaatgtctgatgttgcttattgcccgagatgtgaaacaccctgtatagaggaggaagaccaacatgctcagtgcccaaaatgcttttttagcttttgtaccctttgcagggaacgccgccatgttggcattgcatgcatgacccttgaaatgaagcttcagcttcttcaggatcgtcaaaattcatctcatttaaaggggaatcaaaagcaaattgaacttgcaaagattaatgaaatgctcagtatcaaagcaattcaccgtgattccaagttgtgcccctattgtgacatggcgatttctcgaactggaggttgtaacaaaatgaagtgcggtaattgtggaaagtacttctgttacctctgcaacaaagcactcgatccatcagatccatatggacatttcagggaaggggggtcctgtgaattgttcccacaagaaatggttgacaattggcaaccacgaatcaatcctcgccaggaagtacaacaaatacatgcggaactctttcacctcggtggctcagcttgtcctagttgtcgccaatttaatgtaaaggaagagaatcgcgacgccggtgaattggtttcgcttctgcttgatgtggaaaagtctaatgttgtgtttgatatgcttatcaaagtgtttgcgtcgaattctatgcttgaacatgctaattatgtttttgttagagctaaggatgatgggattgagctgaatataatgtcgtgtaatttcttgttgaagtgtttggttgaggataatagagtggatggtgttgggtgtagtgttgatattagacgggcatctgagattttagggaagatttacatgagtggggaaaccccgaatgttgttacatatggtacttatattaagggactttgtaaagttggtttatttggggttgcgtggaggttaattcaaaacttgtgccgtaaaaaccagcctctcaataaccattgttttaatgctgtcatatatggattgtgtcaaggaggtatattagatgaagcttcagaagtttttaaagaaatgaagaactctggaatattgcccgatgtttatagttatagcattttaatcgatggattttgcaggaaaggtagagtagaccaagcttcagaagtttttaaagaaatgaggaactctggaatattgcccaatatttatagttatagcattttaatcgatggattttgcaaggaaggtagagtagataaagctttagaagtttttgaagaaatgaagaactctggaatattgcccgatgtttatagttatagcattttaatcgatggattttgcaggaaaggtgatatggattcagccataaagttttgggaagagatgactagcaataatttttctccttctgcttttaattattgcagtttaattaaggggtactacaaatcgaaacaattcgctaacgcattgaaagagtttaggatcatgcaaaaacttggtatgtggccagatacaatcgcttgcaatcacattcttagtatttactgcaggaagcccgacttcaataaagccttggcattgtcggagaaatttcaagaaaatggagttcacttcaacccatattcatataatgaattcatccacaggatttgcagaggaagtgttccagaaaaggcactgcagcttttgccagtaatgctgaaaaggaatgtacttcccgatgttgttaattatagtactcttatatcttgctttgccaaaaggttgaactctgaaaaggctgtgatgttattcataaaaatgacaaaagtaggaatcactttcaacgtcaaaacgtatacaattcttattaacctattcatcagtgattgcaaaatggatgtggcatatagattatttaagggaatgaaagaaagtcgtgtatatccagatcagatagcgtatacaagtctagttgctggtttttgtaatactggagaaatgactagggcacgggcgttatttgatgaaatgtcgcgagaaggctgttcaccaaatgtagttacttatacttgtttcattaatgaatatttgaagttaaacaagaacaatcaggctcataagttgtatgagaaaatgaaagaaagaggtgtatatccagatcagatcttgtatacaatgctaattgctgccttttgtaatactggagaaatgaatagggcagaggcgttatttgatgaaatgaagcaggaaggccgctgtacaccgaatgtagttatgtatacatctcagaaggttctgtgtctgaaagctggtgcaattcatggagttaggtag

SEQ ID NO: 583 - DNA, 1704 bp, Medicago sativa
atggcatgtcatgttattgggattgaagttgatattatgtcttgctatttcttgttgaaatgtttggtagatgcaaatagagtgggtgatgatgatgatgatgatggtgtgagtgtgagtgctgatatcagtccggcttctgagattttcgggaacatttataggagtggggaaaccccgaatgttgtcacgtatagtacttatattaagggactttgtaaagctggttctcttagggttgtatggaaaggtgagttagatgaagcttcacaagttttggaagaaatgaagagcatcggaatattgcccgatgtttatggttattatgtttttgttaatgctaaagatgttgggattgaagttgatattatgtcttgcaatttcttgttgaaatgtttggtagatgcaaatagagtgggtgatgatgatgatgatgatgatgatgatggtgtgagtgtgagtgtgagtgctgatatcagtccggcttctgagattttcgggaacatttataggagtggggaaaccccgaatgttgtcacgtatagtacttatattaagggactttgtaaagctggttctcttagggttgtatggaaaggtgagttagatgaagcttcacaagttttggaagaaatgaagagcattggaatattgcccgatgtttatggttatagcattttaattgatgccttctgcaagaatggagatgataagaaagttgttgacttgagggaggatatgaagctcaaccaaataaaaccatccattgttaaccacacttccatcatccaccgtctatgcaagagcaagactatgccgatgcaaatcgtgatgaataagttccgtgctattggtgcttcgggttgcaaatatgatcagactatttatgaaactttagttgatggattttgcagggaaggtgatatggtttcagccggaaagcttttggaggaaatgggtagcaataattttgctccctctgctttttgttattgtagtcaaattaaggggttctacaaattgagacaattcgctaacgcgttgaaagtttatagtatcatgcaaaaacgtggtataaggccagataccatcgcttgcaatcatatccttagtatttactgcaggaagcgtgaattcaatgaagccttggcattgtcggaggaattccgggatcatggagtttccctcaacccatattcatataatgaattcatcaacaagctttgcagagaaagttttccagaaaaagcactgcagcttctgccagtaatgcttaaaaggaatgtacttcccggagttgttaattatagtactcttatatcttgctttgccaaacagacgaattctaaaaaggctgtgaagttattcacaagaatgacaaaagtaggaatcactttcaacatcaaaacgcatacagctcttattgacctatgcatccgtaattgcaaaattgataaggcatgtgacttatttgaggatatggaaaaaaggggtgtgcatccagatcagattacatataatactctaatagctgctttttgtaatactggagaaatgataatagcgaagacattatttgatagaatgttacaggaaggctgttcaccaaatgtcataagtttccgtgtccggaagttggtgcaattcatggagttagatagctctgtcaaggcctccattatatccagctggtatgtgttttga

SEQ ID NO: 584 - DNA, 650 bp, Medicago sativa
ttctagcccctccaaagcatacacaacatctagtgtttccatcataggagacctctagcaatcatttcacgcagaagtttctccgccttttcattctcatctttatgaaagagagcctggatgagagtttcataagttacagcatcaggaatgataccattgtcatccatttttgacaacaaggcctctgcttcatcaaacaagccctctttacaaagtccattgaccataatattatacgtccaagcatttacactataacccttactcaaaagatcctggaaaacatcttgtgcattcttaagtcgtcctactttgcataatccataaataagtatattgaacgtgtacatatctggttgaatgccttgatctttaattttcttaactaatgcaatagcctggtcaacatgatggtttttacataaagcatctattaaacagttgtaagtgaatatattggctggttgaccattatcatgcatttcatcaacaagctcccaagcataggagattctccctgatttgcacaaaccatcaatgagagaattataagttaccttatcaggagcaattcctttgaactgcatatcattaaagagactcaaggcttcatcaaccattttaatcttacaaaatccattaatcat

SEQ ID NO: 585 - DNA, 1905 bp, Medicago sativa
atgtcgaactataatcgagttggttcggttcggttcattgccaaccctacccatacccatcagctgaaagaagggtgctgccgcggtgcttcacctcgcaccgcgattcagcagttaagccgcccgattgacaattatatttcaacggaagcaatggtcactgataaacttactagatccatacaaggtccaatcttgcagtcattaagcataccgacaatttcggagttgttgagtaaacaacattggtcagagctcaaacctcatctaagagtaaccaaacctgcgacatttctagatcaattgctcaatgccggagtcgattcagagcttgttttaaggttctttaagtggtctcagaaagagtaccgactttcatatggtcttgaaccaacttccaaagttttacattttctagcaaattcaaaaaggtattctaaagttaggtcttttctggatagttttgttaagaatgagaaacatacagtctcttctgtttttcactcccttttgttggacggtggtcgaccgggtgctactgctctgataattgatatgttggtgttagcatatgtgaaaaatttagagttgcactgtgcttatgaagcgtttacgcgagctaaagattatggatttaaattatcactgacttcgtgtaatccgttgttgagtgcgttggtgaaggagaataaaattggtgatgtggaatatgtgtacaaggagatgataaagagaagaattcacactaacttgaacacatttaacattttcattaatggtctttgtagagctggtaagttgaataaggcagaggatgctattgaagacatgaaggcatggggaatttcaccaaatgtagttacttataacactcttgttgatggttattgcaagaggggcagtgctggaaaaatgtacaaagctgaagcttttatgaaggaaatgcttgctaataaaatttgtccaaatgaagttacctttaacactcttattgatgggttttgtaaggatgagaatgtagcggctgcaaagaaggcttttgaagagatgcaaaagcaaggattaaaacctaatatagttacttataactcactgataaatggtctatgtaataacggtaagctagaagaggctattgatttgtgggataagatggttggcttgggtttgaagccgaatattgtaacttataatgctcttattaacgggttttgtaagaagaagatgatgaaggaggcaacaaaagttttcgatgatgtaagtaagcaagagttggttcccaatgttataacatttaatactatgattgatgcatattgtaaggaagggatgatggaggagggattttcactttgcagttcaatgctagacgaagggatcttgccaaatgtttcgacctataattgcttgattgcaggcctatgcagaaaacaggacttacaggctgcgaaggagctacttaatgaaatggagaacaagggtttaaaaggtgatgttgtaacatacaacatcttgatagatggattgtgcaaaaacgacaaatcaagaaatgcagaaaagttacttaatgaaatgttcaaccttggtctgaaacctaatcatgtgacatataatactttgatggatggctattgtatggaggggaaactcaaggcagcattgaatgtcagaacgcgtatggagaaagaacgaaagcagccaaatgttgttacttataatgtcttgattaaaggatattgtaaaattaataagctagaggctgcaaatgggcttcttaatgagatgttggaaaagggtttgaatccaaaccgtactacatatgatatagtaagactggaaatgttggagaaaggttttagtcctgacatagaaggacacttgtataatatctctagcatgtcttaa

SEQ ID NO: 586 - DNA, 2592 bp, Medicago sativa
atgaagctccgccatctccgtcgcgcacgtctctccctctcacctcttcaaagaaccttttccacttccaaatccaccaacgaaaacgacactcatttcatcacacacatttccgacattgttcgaggaaatctaagttggaaaatcgcattcaacgacccatcaatttcatccacattgaaaccccatcatgtcgaacaagtcttaatcaacaccttacatgattcaaagttagctttacgcttcttcaacttcctcggattacacaaaaacatgaaccacacgacaacctcgtttgctatcttagttcatgccctggttcaaaataagcttttttggcccgcgaattcgcttttgcatacccttctccttcgtgggtcggatccaaaatttgtttttgagaaatttcttgaatctcataagcaatttgttttaagactcatgcttggtaatactttgttgcctgaggttagaactttgagtgcaattttaaatgggttattgagaattaggaaatttatattggtttgggaagtttttgatgagtctgtgaatgctggtgttaaacctgatccttatacttgttccgctgtaattcggagcttgtgtgagttaaaagatttttgtagagctaaggaaaagattttgtggatggaatctaataggtttgatttgagtattgtgacttataatgtattgattcatggtctgtgtaagggtggtggggttttggaagctcttgaggttagaaaatcgttgagggaaaagggtttgaaggaagatgttgttacatattgtacattggtgcttggattttgtagggtgcaacagtttgatgatggaatttgcctcatgaatgaaatggttgaattagggtttgttccaactgaggctgctgtatcggggttagtggatgggttgcgaaagaagggaaatattgacagtgcttatgatttggttgttaagttaggaaggtttggttttctaccaaatttgtttgtatataacgcgttaataaacgctttgtgcaaaggtgaggatttggataaagcagagttgctttataaaaatatgcattcgatgaacttgccgctgaatgatgttacttactctattctgattgattccttttgcaaaagggggatgttggatgttgctgaatcttattttggtagaatgatagaagatggtataagagaaaccatttatccctacaactctttgataaatggccattgtaagttcggggatttgagtgctgctgagtttctgtatacaaagatgatcaatgaagggttagagccaactgccactacctttacaacattgattagtggatattgtaaagacctacaagtagaaaaagcattcaagctatatagggagatgaatgagaaagaaattgctccaagtgtttatactttcactgcacttatttacggactttgcagtacaaatgagatggccgaagcatccaaacttttcgacgaaatggtggaaagaaaaatcaagccaactgaggtaacatataatgttatgattgaaggctattgtaaggctcataacatggataaagcctttgaattgcttgaagacatgctccataatggccttgttccagacacatatacatacagacctcttataagtggcctttgttctactggtagggtttcagcagctaaagattttattgatgatctccacaagaagaatctcaagttaaatgagatgtgctatagtgcacttctacatggttattgcggccaaggaagactgacggaggcactgagtgcttcttgtgagatgattcaacgaggaatcaacatggaccttgtttgccacgctgttcttattgatggtgcaatgaagcagcaagacatgaaaaggttatttggtctcttaaaaaagatgtatgatcagggattgagacctgatagtgtgatatatacaagtatgattgatgcatacagcaaagaaggatcttttaaaaaatccggtgaatgtttagatttaatggttactgagaaatgctttcctaatgttgtgacttatactgctttcatgaatggtttatgcaaagttggtgaaatcgatagagcgggtcacctttttgaaaaaatgctgactgcaaatatctctcctaattcagttacatatggttgttttcttgacagtcttacgaaggagggaaatatgaaggaagctacagaccttcaccatgagatgcttaaagggcttttagcaaacactgcaacatataacattcttatccgtggcttctgcaaattgggtagattaatcgaagccaccaaagttctttctgaaatgactgaaaatgggattttccctgactgtataacctattcaactataatttatgagcattgcagaagtggcgatgtaggagcagcagttgaactgtgggataccatgttaagaaaaggtgttgagccagattcagttgcatttaacttgctaatatatggttgctgtgttaatggagcactcgacaaggcatttgaattgcgtaatgacatgctgagtagagggttgaagccaagacaaattttacaattgcagaaggtgtaa

SEQ ID NO: 587 - DNA, 839 bp, Medicago sativa
caagcacaaaaattaattaaaacataaaaccaatgcagacttcctagagactgatctagcctccaccgtttttttttttctgtttagatcaaagaagatttaaaattaatagataataatgtgaaaagggaaaagaaaacacgggaagcactgcctctgtcctgactatatctcggaaaattatctcacaccagtatataactgatcaagatccatgaaacagtgaaaaataaagcaacaattggtgagatactagtagatgaagatgcactttgtgtggaaggagtagtggtggtggtggttgcagcaggggtgccatcagaaggtgaacctttccctgatggcgatggtgttgcagaaggagcagaagaagcactagaagaagccttaactttaacagaaagtttcatgccacctgtgcaatgtccaggaacagcacatatgaagtaatgtgttcctgctttcttgaggggaatggttgtgggaccactgctgtcagtactaattgaatttccagttgtgcatgatttatagtcactttctttaacttcatccactgtgtgcccagctccatagttgaatacgagactgtcaccaactgcaaatgttttgtcactagcccatgtgttataatcagaaccaattgcccaacctgatttatcaccaacggtgtggacagttgcaagagttggcactgccacattgatcactaaaaagaagcctaaaatcaaaggattagagaatgtcatcttaagagatggctatgttttttcccccggccataatgaaggaaggaggctatgaggatccccggccatatggcctgcagtcgaccatat

SEQ ID NO: 588 - DNA, 841 bp, Medicago sativa
aagggttaagtctcaaccttgcaaaccgactcacacaactcactataattgctataggcatctatagtttataccaagaaaaatagtgaatatgactgagggaagaggcagtgcttctatgaacatggtcactctaatttcactgctgtgccttttggttctggctgaaagtgctaatgcagcatcttacaccgttggaggaactgggggatggacatacaatactgatacttggcctaatggaaaaaagtttaaagctggtgatgtgctcagcttcaactatgattcaaccacacacaatgtggttgccgtggacaaaagtggatacaacaactgtaagacaccgggaggtgctaaagtgttcagttcagggagtgaccaaattaggctatcaagaggacaaaactacttcatatgcagctatcctggtcactgccaatctgggatgaaggtttccatctatgcagtttagtcctctagctaagtgaccacagtagttaattagttaattaatggtcaattagctgtagtggtaatggtatgatttctttaattaccatataaataacagcatgagtactaggctactagctatatgttgatttggtgatcaattactattattattattatgtatgtaaaaggagtgtggtgaggtggctttctttataaaattgtatgtttgatatttttatttttgtggtgtgctgtgtgatgtgaggatatatatatatatatgtatgatagagattaactatcttgcataaagaaacatttgtttgtttccggtctagtttaatattttagtttgtttaaaaaaaaaaaaaaaaaacgtcgaggg

SEQ ID NO: 589 - DNA, 1358 bp, Medicago sativa
cacggttttctagcaaataatagtagagaaacatggctctgggaagaggcagtgcattggttctactagtctgcttttttgttcttaactctgagttggctcatgctgctacctacactgttggaggtcctggaggttggacctttaacactgttggatggcctaatggaaaacgctttagggctggtgatacccttgtgttcaactatagtccatcagctcacaatgtggtggcggtgaacaaaggagggtatgatagttgcaagactccaagaggagcaaaagtgtataggtcaggaaaggatcagatcaggcttgctaggggacaaaactacttcatttgcaactttgtgggtcactgcgagaataaaattgaggtaaactttgctcaaactgaaaataagtccaagaaaaaaggaaaaaaaaaggctaaaccaaagaaaaatgataaatgtgtagaagagaataagcaaacgcaaaatgatgaatcgattgcagcagatttggaagaggatacctctgtttctgttttggatacagtgagagctaagcttaatgacttgtttataaatgcccaaactaagcattatgttatggctactactttgaaaaagaagattgatgggttaattgcagacgaaaaggagcatgttacacttgcattgaaaaaagctgtcactgaattgtacatgtatgcacaaaaaaaggttgctgctttgtacgtggaggcggaggaagaaagtgttgaatcctctaacattgttgaacctggtaatgatgtgtcaaacatatattcaaaatttctgtggacaccaaagccgatttctggatcagacccagcatcttccttagtcattaaccttggagagtataaatggactttcatagttcgtcggacgggaacctcgttgcaatttcagttatttgctgatggagacaacaatccaaggttgaacttttatgctctgtgcaaattagcgataattcacccacttgaccccgggcaaactgattgttttgatgcatttagcttcgtttctaaagattacatgggcgatgtatttgggcttgcggctgcctgtgaaatagattttcttgaccctgagggtaatgttaaagtagaattgcagattcaggtgattggtgaaaaagttttcccgcctttccttgaaaggaagtttcgaattgagctttttttggcgtttacgacagatttggacaacatttgttctacattctttgagaagacaaaagaaaatttgaagagtctggttcaagataaaaacaaggggtcaagtttactaatatatggtggaatgagtaaggactctaggcatcttgtcattagttgcccttaa

SEQ ID NO: 590 - DNA, 3723 bp, Medicago sativa
atgaaggaacacataatagtcacattttcaacccaaacaactttcaatagagaaaagcagcgtctaagcaagggcgaggacactcgctacggtatcactagccatcttcacgctgctctgattcataaatcaatcaaaacatacgtggatagcctgcttgaaagaggagaagatatttggccaactcttgccaaagcaattgaggaatcacatgtttccatcgttgttttctctgaaaattttgctacctcaacatggtgtttggaagaactggtcaaagtactggaatgcagaaaagtcaaaggtcaagttgttatacctgttttctataaaacagatccatctgacataagaaatcagactggcagttatgagaatgcattcgcaaaacatgagcgagatcttgggaccaatgatcttaaagtgcttaactggaaaatatttatgaatcaaggttttaacaacggtcaaggtcgtggtagcgttatgtattttgtgatttcggctgttaaggatgctgcattacatattgcggtcgttgtgctacaactgaggtaccctaatgaactagaaggtgtagtgagaaacgaaaaaaactgtgaacaggttgaatcattggtggaacgttttccaagacttggaatttggggtatgggtggaatgggaaaaacaatcattgctaaagtcttgtttgccaagctgtttgcccaatatgatcatgtctgctttgctaatgcaaaagaatattcacttagtaagcttttctctgagctactaaaggaagaaatttccccatctaatgtaggatctgcatttcatatgaggaggctgagaagtagaaaagttttgattgtacttgataatatggacagcttagatcagtttgaatatttgtgcagagattacggcgagctaaataaagatagtagactcattataacaacgagagacagacagttgctgagtggaagagttgattggatatatgaggtcaagcagtgggaatatccaaaatctctagagcttttttgcctagaagcctttgagccaagtaatccccgagagaagtatgagcatcttttgcaaagggcaatcacttatgcagggggcgttccgcttgcccttaaacttttggctttacatcttcgtacaagagatattgcattttgggaaagttcttttaagaaactcgatgatcatcgtgatgacaaattgcacaaagttttaaaagtgagttacgatgaactagatgcactagagaagaagatatttctagacattgcattcttcttcataggagaaaagaaagagtctgtcacaaagatactagatgcttgtggtttcgaaccaaatagcggaatagtagtcctcaaagacaaggctttgataactatctcaaataaccaaacaatacaaatgcatgacttactgcaaaaaatgggttcggacataatatgtaatgattgtggcgaggacccggcagcacatacccgactgagtgggagtaaagctcgtgcagttattgaagaaaacaaggggagtagctcaattgaaggcataacattggatttgtcacaaaataatgatttgcctttaagtgccgacacattcaccaagatgaaagccttaagaattcttaaattccatgcaccctctaacctgcagagatgtactaacacatacctcaaccttcccaaatttcttgagccattttcaaataaactgaggtattttgagtggaatggatacccttttgaatctcttccacaacatttttatgccaagtttcttgttgagatccgtatgccgcacagcaatgttaaacaactgtggcaggggacgaaggaactgggtaaattagagggaattgaccttagtgaatgcaagcaatttgaaaagcttccgaatttttctaaggcgtcaagtctgaaatgggttaatctttctggttgtgagagtctggttgatcttcatccatctgttttatgcgcagatacacttgttactttgatactggataggtgtacaaaggttaggagggttagaggtgaaaaacatttaaattttttggagaagatcagtgtggatgggtgcaaaagtctggaggaatttgcagtgtcctcggatttaattgaaaacttggatttaagcagtacaggaatcaaaacactggacctatcaattggacgtcttcaaaaactcaaacaacttaatctagagagtttaagactcaaccgtattccgaaggagttatctagtgtgagatctattagggaattgaagatttctggcagtagactaatagttgagaaaaaacagctacatgagttgtttgatggcttacaatccctacaaatactacatatgaaggattttataaaccagtttgaactccccaacaacgtccacgttgcatcaaagttaatggaattaaaccttgatggaagcaacatgaaaatgttgcctcaaagcattaagaaacttgaagaactggaaattttgtctttggtgaattgcaggaagcttgagtgcataccagagcttccacctctaatcacactgttaaatgcagttaactgcacatcgctggtttcagtactccgtgtggccgtccgcagctacaactataacagtgttgatgcttgtcaactaggaacaagtatcccgaggctattccaatgtctaacagcttctgactcttccattaccattacattgcttcctgatcgttccaacttgctgggattcatatactcagtggttctttctccagcaggtggaaatggaatgaagggtggaggagctaggataaagtgtcaatgcaacttgggagaagaaggtataaaagctacctggctaaatactgatgtcacagaactgaactcggatcatgtttatgtgtggtatgatccattccattgtgacagtattctcaaattttatcaacccgagatttgtttcgagttctatgttacaaacgatactggccgggaagttgatggttcagttggtattaaagagtgtggggtacgactagtaagtgttcaagaattggagagtgttttgccggaattggattcacaaaagaaagaagagttgaagaaggcggtggaattagaatcaggacgtaggataaccttgaagccaattgttcaagaacaaagatcagcaatggttaaactagaatcagttgaacttgaaagtcacttctttaatgtggaaaagagcatcagatcttctaacaacgaaaccaataccaatgctggaaccagtcatgaggagaatattacaaattccgcaaaagtcttcgaaagcaaaggaaatgaaggaagaccaactgaatctgaagctggattgtatctgccggtaatgtcagcgtttgaaggcaacacttctgataacaagtcaagtgaaaacaactatgatgggaaagacaattttgatgagaccaagcaatcagaaggaaaaccaaatatacaaggacaggttattgttcccgacaccactgatccaataagtaaagaaaattcaccaatggatctaagaaactttgaagatgaatcagatgaggacccttttgctgaacttgagagcatcctgctgggaagtccagagtctccgccaaaagtaacctgttccacaagtgatgatgttgctgtaaaagaagctttgcacaaccttgaatgcctatttgaaaattcactagagtccattctctatgac

SEQ ID NO: 591 - DNA, 4398 bp, Medicago sativa
atggctagtagcagcaaatcaacttcagctcttgtgacttcttcaaagaaaaatcattatgatgtgtttgtcacctttagaggtgaagatactcgcaacaatttcactgattttctttttgacgcccttgaaagaaaagacatttttgcatttcgagatgacactaatcttcaaaaaggtgaatccataggatctgagcttcttcgagcaatagaaggatctcaggtgccaggaaaacatgttcttcctgttttctatgatgttgatccttctgaggtgcgaaagcaaagtgggatttatcatgaagcttttgtcaaacatgaacaaagattccaacaagaccttcagaaggtgtcaagatggagggaagctctaaagcaagtggggagtatcgctggttgggatctacgtgataagccacaatgtgcagagattaaaaagattgttcaaaagataatgaatatattggaatgcaaatcttcatgtaattcaaaagatttagttgggataaattctcgtatagaagcattaaaaaatcatttacttttggactcggttgatggtgttcgtgctataggaatttgggggatgggaggaatagggaagacaacccttgctttggatttatatggccaaatctctcatcgatttgatgcatcttgtttcattgatgatgtaagcaaaatttatagattacatgatggtccacttgaagcacaaaagcaaatcatatttcaaactcttggcatagaacaccatcaaatatgcaatcgttacagtgcaacatatttgatacggcatagactatgtcatgaaagggcacttctgattcttgataatgtggatcaagttgaacaattggaaaaaatagatgtgcatcttgaatggttaggtgcaggtagtagaatcattatcatttctagagatgagcatatattgaaaaagtatggagtggatgtagtttacaaagttccacttttgaattggagagattcttacaagttattttgtcgaaaagctttcaaagttgagaacattattatgagtaattatcaaaatttggcaaatgagatactgagatatgctaatggtctaccactagcaattaaagtaatgggctcatttttgtttggttgtaatgtgactgaatggaagagtgcattggctagattgagagagagtccagataaagatgtcatagacgtgctgcaattaagttttgatgggctaaagcatactgaaaaggaaatatttcttgatattgcttgttttttcaactctgaatgtgagaaatatgttaaaaacattcttaattgttgtggatttcatgctgatattggattaagagttctcattaataaatcacttataagcattaatggtcaaaacattgaaatgcattctttgttggaagagctgggcagaaaaattgtgcaaaatagttcaagcaatgacccaagaaaatggagcaggttgtggtctacagaacaactctatgatgttattatggcgaaaatggaaaagcatgttgaagccatagttttgaaatatactgaagaggtggacgctgaacatttgtcaaaaatgagtaatcttagattgctcatcatcgtcaaccatactgcaactatctcaggattcccaagttgtctttcgaacaaattaagatatgttgagtggcctaaatatcctttcaagtatttgccaacaagttttcaccccaatgaactagtagaattgattttggatgggagcaacattaaaaacctatggaaaaacaagaagtatcttcccaatttgagaagattggatctaagtgactctagaaagctagaaaagataatggattttggagagttcccaaatcttgagtggttaaatttggaaggatgtgaaagacttgtggaattggatccatcaattggacttctaagaaagcttgtttacttgaacttaaaagattgctataatctacattgcaagttgttggaatctttgcctcaacttccttttcctaccgctatcgggcgggaacgagttgagggcggatattaccggcctacaggattgttcatcttcaactgtccaaaattgggtgagagggaatgttacagtagcatgacattttcatggatgatgcaattcattaaggcaaaccctttctatttgaataggattcatattgttagtccaggaagcgaaataccaagttggatcaacaataagagcgtgggtgattcaataagaatagaccaatctcctattaagcatgacaataatatcattggttttgtatgttgtgcagtattttccatggcacctcatcgtgggaggtttccatcgtcggcccatatggaactggttttgaaatatccatttaataagcgtaagtcagataagtctctgagtagaataactgtgagtgttccggggcaagctttgggtatggaggtgaagagttgcgggtatcgttgggtatgtaaacaagacctacaagagttcaacttaacaatgatgaatcacgaaaaaaccttggctcagaagtgcaagattttggcaattgaagatgagacacaaccagaacaagaatcattcatctcacaagtcataactacttcacaaagaagaaagtcaacaagtgataacaaatcaactgcaacaacaatctctgttgtcaacaacaagcaaagaaaaaaatctcgaaccgccatatcagccacagaagcagaagtatctgtggaggtaccagattcacctgttacagatgaagtttctactgaatctccacagaaaaaaatcttgaacctccatatcattggtcgattcattggtcagttcctcaacaactgttgccaacaaggtagcactgatacagacatggacaccggatacgacacggacactataaattcagatgctaaaagtttggtttctgaagaagacttagatgctgtaaattcaattattgaagacctcaacaactgttgccaacaaggtagcacggatacggacatggacaccggatacaacacagacactgtaaattcagatgctgaaagtttggtttttgaagaggacttagatgctgtaaattcaattattgaaaagactattcagacagatattgcaacaagcaatgtcgaaactgactcaccggttgaagtggctgatgaaattaaggaagaagttccaactgcaactgagacagacagcgatgtagttgagcctgatgacaatgttgaagctgttctagagaacaataagattgatgctagtttgagtggacaaaatgtaacagaagaaaacaatgaagttctctctcctgaaagtcctgcaaccaaagaagtgccagaacaaacaccagcagcggcacaagttgaacgtgaagaagttgcaattgcatttgaaacaaacaatggcgtatctaactctaatggacaaaccagcattacagcttcagatgaaggcttgaccaaagagtttatggaaacagctcatgttgcttcattatcgagttatcttaatgtcaagaaatcaacggtagtggtctcggaaaagaaagccattgaaagaaagccattgctgaaactgaaggtgatcttgaaaaggctcaagcatatataccttagtaaaaaagctctctcatcagctggcaataaatccggcaggctagcaactgaaagaaaaatcggtacattcattcatgactcatgcaacggtgttctaattgaagggaactgtgaaaccaactttgtaatgcaagttgatgcttgtccacatgttcagtttgtatctattgaagatattcccgaaaccattgtgaagaaggaaaaagaacttgagatgcagcagagggaagacctttcttcgaaacccgagaatataagagagaaaattgtcgagggaaggatctcaaagaggttaggagagcttgctcttctagagcagcctttcattaaggatgacagcgtttcagtgaaatatttggtgaggcaaagtatagctgctattggagagtttaaagtgcggcgttttgttaggaaatcaacagtagtggtttcggcctcattggttaaacaattaagagaagaaaccggtgctgggattatggactgtaagaaagcccttgccgaaactgaaggaagaatcggtacatacattcacgatgcacgcatcggtggtctaattgaattgaactttgaaaccgactttgttggcagaagggagagattcaaggagttggttgatgatcttgcaatgcaagtggctgcttttccacagaggttccatgacactcactttgatcctaatatgatgttagatggtttcaattccataagattaaactgtattatattctccattgcattggctacaaatcagatatatgtgatttaa

SEQ ID NO: 592 - DNA, 1441 bp, Medicago sativa
tggctttgttctctctctagattctctgtttctgtaaactaacaatggcggcgctgcttggtcacattctgaagacccaaaagaattcctcgcttcttcgcaacatcacttcctcttcgttgcatcaaacacctttcattctcccacctttatctcaagcaaggcggataggaaatgtagcagaaagtgtttgtggatttgatgagatggtgagagacaaggaaaggagatattacatgcttggtgggaaaggtggtgttgggaaaacaagctgtgctgcttctcttgctatcaaatttgcaaatcatggacaccccactatggtggtttcaactgatcctgctcattcattaagtgattcttttgctcaggatttgacagggggaaaacttgttccggttgaaggagtgaattctccattatatgctcttgagataaaccctgataaatcaatggaagaattccggacagcaggtcaaaagcttggaggtcggccggctaagagtttggtgcaaagcatgggacttggagtggttgctgaccagttaggggaccttaatcttgaagagctgttgcacactcctccacctggaacagatgaaatcattgcaattgctaaggtgatgcaatttcttgagtctgaagaatatagtatgttcagtcggatagtttttgatacagcaccaacgggtcatacacttcggctactatcattgcctgacttcttggatggatctataggcaaacttatgaagatgaagatgaaattaggttcagttttcaaatccttgttgggaaaagaacagcctcaaaacaatcctttagacaaacttgaaaagctcaaggagagagtggcaaaaatacgggatcttttccataattcagacactaccgaattcataatagtgacgattcctacggttatggcaattagtgaatcatcaaggttacatgcatccttaaagaacgaaagtgtacctgttaaaagactaatcgttaatcaggtcttacctcctacgacgggctgcaagttttgttcgatgaaactaaaggatcaaatgcgcgcaattgaaactatccacaatgattcagaacttggtggattgagattatgtcaggcacccttggtggatatggaaataaggggtgttccagctctcacattcatgggagataagctttggagataaaacttacatcgtagataattcacgaatttcacgaacgtggatcacattatagagatgctgttaaatttttttaggaagtttagagactactctagcattctttcaagcagtgaaatggggtactaacagtttgttacattatctattttaagttttagatgttagtctctcttttcttgtttattgaatggtactatctgataaggcaacaaatgtatgttacaactagcaattcatgcatatctttattg

SEQ ID NO: 593 - DNA, 3174 bp, Medicago sativa
atggctagcagcagcaaatcatcttcagctcttgtgacttcttcaaagaaaaatcattatgatgtgtttgtcacctttagaggtgaagatactcgcaacaatttcactgattttctttttgatgcccttgaaacaaaaggcattatggtatttcgggatgtcattaatcttcaaaaaggtgaatgcataggacctgagctttttcgtgcaatcgaaatatctcaggtttacgttgcgatcttctcaaagaactatgcttcctcaacgtggtgcttgcaagaattagaaaagatatgtgaatgcattaaggggtcgggaaaacatgttcttcctgttttctatgatgttgatccttctgaggtgcggaagcaaagtggaatttatagtgaagcttttgtcaaacatgaacaaagattccaacaagactctatgaaggtgtcaagatggagagaagctctagagcaagtggggagtatatctggttgggatctacgtgatgagccactagctagagaaattaaagagattgttcaaaagataatcaatatattggaatgcaaatattcatgtgtttcaaaagatttagttgggattgattctcctatacaagcattacaaaatcatttgcttttgaactcagttgatggtgttcgtgctataggaatttgtggaatgggaggaatagggaaaacaacccttgctacgactttatatggccaaatatctcatcaatttagtgcatcttgttttattgacgatgtaaccaaaatttatggattacatgatgatccactcgatgtacaaaaacaaatcctatttcaaactctcggcatagaacaccaacaaatatgcaatcgttaccatgcaactactttgatacaaaggaagctatgtcatgaaagaacccttatgattcttgataatgtggaccaagttgaacaattggagaaaatagcggtgcatcgtgaatggttaggtccaggtagtagaattattatcatttctagagatgagcatgtattgaaagcgtatggagtggatgtagtttacaaagtttcactattggattggaatgaagctcacatgttattttgtcgaaaagctttcaaagatgagaaaattattatgagtaattatcaaaatttggtagatcagatactacattatgctaaaggtctaccactagcaattaaagtattgggctcgtttttgtttggtcgtaatgtgactgaatggaagagtgcattgactagattgagacaaagtccagttaaagatgtcatggatgtgctgcaattaagttttgatgggctcaatgaaacggaaaaagacatatttcttcatattgcttgttttttcaacaacgattcggaggaagatgttaaaaacattctaaactgttgtggatttcatgctgatattggattaagagttctcattgataaatcacttgtaagcattagttattcaattattaacatgcattctttgttggaagagctaggcagaaaaattgtgcaaaatagttcaagcaaagaaccaagaaaatggagcaggttgtggtccacagaacaactctacgatgttatgttggagaatatggaaaagcatgttgaagccatagttttgtattacaaagaagatgaagaggcggactttgaacacttgtcaaaaatgagtaatctcagattgctcttcatcgccaactatatttcaacgatgttaggattcccaagctgtctttcgaacaaattaagatttgttcactggtttagatatccttccaagtatttgccatcaaattttcaccccaatgaacttgtagaattgatcttgacggagagcaacattaaacaactatggaaaaacaagaagtatcttcccaatttgagaacattggatctacgtcactccagaaatctagaaaagataatagattttggagagttcccgaatcttgagcgtttagatttggaaggatgtataaaccttgttgagttggatccatctattggacttctaagaaagcttgtttacttgaacctaaaagattgcaaaagtctagttagcatacccaacaacatattcggtcttagctctcttcaatacctaaatatgtgtggctgttccaaagtatttaacaacccaaggcgtttgatgaagtctggtatatcctcagaaaagaagcagcagcatgatatacgtgaaagtgcatcacatcacctccctggcctaaaatggatcattttggctcacgattcatcacatatgttgccttccttgcatagtttatgttgtttgcgtaaggttgacataagcttttgctatctaagccatgtgcctgatgcaattgaatgtttacattggctagaaagattaaatttagcgggaaacgattttgtgacattacctagcctgaggaagctatccaaacttgtatatttaaatttggagcattgcaaattgttggaatctttgcctcaacttccttttcctaccaatactggggaggttcatcgtgagtacgacgactatttttgtggtgcaggattgctcattttcaactgtccaaaattgggtgagagggaacattgcaggagcatgacacttttatggatgaaacaattcattaaggcaaacccacgttcctcttctgagattcaaatagttaatccaggaagtgaaataccaagttggatcaacaatcagaggatgggttattcaatagcaatagaccgatctcctattaggcatgacaatgacaataatatcattggtattgtatgttgtgcagcatttacgatggcaccctatcgtgaaattttttattcctcggagttgatgaatctggctttcaagcgtattgattccaatgagaggttgttgaaaatgagagttccagtaaagctcagtcttgttacgaccaaatcaagtcacctatggattatctacttaccccgagagtaccccgggtattcctgtcatgaatttggaaaaatagaattaaaattttttgaggtggaaggtttggaggtcgagagttgcggttatcgttgggtatgtaaacaagatatacaagaattcaatttaatcatgaatcacaaaaattccttaactccaaagtgcaaaattttgacaattgaagatgagacacaaccagaaccgcaaccataa

SEQ ID NO: 594 - DNA, 3525 bp, Medicago sativa
gttcaggttcgtattcctatgtctacgatgtgttcatcagctttagaggggaggatacctcggcctagggtttacgtggatttctgtacaagactctatctgaaaagggattccacaccttcattgaccaccacgcttgacgcgggaagaggaacaacgaagacacttgtagatgcaattgaagagtccaggattgggattgttgttttttctgagaactatgcttcctccacatggtgtctggatgaacttgcgtacattattgactccttttccaataagaaaaacttccgtcgatctgttttcccagtattttacaacgtagatccttctcacgtgcgacatcagagtgggatttatggacaggcacttgactcgcaccagaagaacaacaacttcaattcagagaaattgaacaaatggaagaacgctctcaaacaagcagctaatttgtccggtttccattttaaacatggggatggatatgaatatgaattaattgacaagattgtaagacttggtctccaccaaaattgattccaccccttatttacgtgttgtggatcacccaattggtctcaattatcgagtgttagaactaaactggcttctcaatcataatactcatgctgctactgccaccgttggatcccatggactcaaactgctcggtatctacggtatgggtggaatagggaaaacaacccttgctcgagctgtattcaatttcatttccccccaatttgatgccttttgtttcctcgaagatgtcagagaaaattcagcaaaccacggcttagtacatcttcaacaaactcttctcgccaccttagctggacagaagaagaagaagaaagacttccaattagcaagcatcagtgaaggacttctgctattaaagaatatgctccaccgcaagaaggtccttttggttcttgatgacgttaacagctcagatcagttgcaagctactcttggaagaggcctcgacacttttggttatggaaccaccatcatcattactacccgggacaaacacttcctaacaactcacggggttcatacgacatacaaggtagaggagttgaccaaggatgagtccctcgagttgctttcttggaatgctttcaagaccaacaaaatttatccagattatatcgacctgttaaaccgcgtaacaacttgcgcatctggccttcctttggctttggaggttataggctcatacctgcatgggaaaggagtaaaagaatgggaatctgcattagactcctatgaaaagattccttctaaagatatccaaaccatacttaagcaaacctacaatgctttggatggagatctcaggcaactttttctcgacatcgcatgtttcttcaaaggatacgaactctcagaggttgaatacctactcagtgctcaccacggttactgcttcaaaccccaccgtttcagattcttgctggaaacatctctcatcaagattgacgagcacaatcatgtgaaaatgcatgacttgatacgggacatggccagagaaatcgtgaggcaggaatcacccgaccaccccggcaaacgcagcaggctatggcttactacggatatcgtcgaagtttttgttacttgcacgggaacaagtgaaattcaaaccatcgttctggatttccccagatatgaaaaaatggtacggtgggacggaaaagccttccagaagatgacaggcctccagacacttattattagaagtctgtgttttgctgaaggtccgaagaatcttccaaatagtttaagagtgctggagtggtggggatatccttcacagtctttgccttcttatttttaccccaagaaattagctgttctgaagttaccgcacagttcctttatgtcactggagctgtccaagtcaaaggcaagttaccgcacatgttcattctcacggctgtctcttgattcttgtgagaatttagttgaaattcacgactctgttggattcttggataaacttgaaattctgaatcttgggagttgcgcaaagcttcggaatttgccacccatccatttgacctctctccaacacctcaatctttcacattgttcaagtcttgtgagttttcctgagatattaggaaatatgaaaaatattacaagtctttctttggagtacactgccataagggaatttccatattcaatcggaaatcttccccgacttaaaagtttagaactgcacggatgtggaaatcttctgttaccaagtagcattattctattgtcagaacttgaggagttgagtatttggcaatgtgaagggttgaaatcatataagcaagacaaaggtccagaaaaagttggttcaacagtgtcttcaaacgtgaagtatattgagttcttttcttgcaatatatcggacgacttcattcgaataggtctttcttggttttcaaatgtggtagaattgaacctttcagcaaacactttcacagttcttccaacatgcatcaaagaatgccgctttttgacgatacttatactagattactgcaggcaacttcgagaaatcagaggaattccaccaaatttagaaatattctctgcaatacgatgcacatccttgaacgatttagacctcacgaatcttcttgtgtccaccaaagtctgttgtcctttgagagagcttgttttggatgactgtgaaagtcttcaagaaattagagggattccacccagcatagaacttttgtccgcaagaaactgcagatccttgactatctcgtgcagaagaatgttactgattcaggagttgcacgaggctggaaataagagcttttgtttgcccggaacacaaatgccggattggtttgagcaccgtagcaaaggacattcgatttctttctggtttcgtggcaagttccctgcactatctctctgttttgttggactcatgcataaaatccctaccgggttcagacccattgtgatcatcaatggcaatataatgaaaacaatgttgccagctgaaaaatggtttgattttgagttcccagtgttaactgatcatatatttattgttggtgaaagacacataaaatttgaagataatatggatgaagtactttcagaaaatgaatggaatcatgcggtgatttctattgatattgattttaaatggagctcaagtggactgtttgctgcgtggattggactccatgtgatcaaacaaaaatgcagcatggacagaattcaattcaccaatccttgcaactgctgaaagaaaagcatttactggggaacacagtagattctcagagactattggatcggctgcaaaaataaacgacttcattttatatattgcaaccatatttaaaacagggatgatagtggctttcacctctagcacttctagcattatatgatttgaagaccaaaccatggcttctttgttgcatgccttgagatttggccacaggaagaaaggtcacactgtaagacccaggtgtggaaatagcaacttctgcaagt

SEQ ID NO: 595 - DNA, 3813 bp, Medicago sativa
atggccaacagtagcaactcatctttagctcttgtgacttcttcaagaagaaattattatgatgtgtttgtcaccttcagaggtgaagacactcgcaacaatttcactgattatctttttgatgcacttgaaaccaaaggtatttatgcatttagggatgacacaaatcttaaaaaaggtgaagtcataggacctgagctccttcgtgcaatcgaaggatctcaggttttcgtcgcagtcttttcaaggaactatgcttcctcaacatggtgcctgcaagaattagaaaagatctgtgaatgtgttcagggacctgaaaaacacgttcttcctgttttttatgatattgatccttctgaggtgcggaagcaaagtgggatttattgtgaatcttttgtcaaacatgaacaaagattccaacaagaccctcataaggtgtcaagatggagggaagctttaaaccaagtggggagtatctctggttgggatctacgtgataagccacaagctggagagattaaaaagattgttcaaaatataatgaatatattggattgtaaatcttcattcatttcaaaagatttagttgggataaattctcggatagaagtattacaaaatcatttacttttggactcggttgatggtgtttgtgctattggaatttgtggaatgggcggaataggaaagacaacccttgctatgactttatatggccagatatctcatcaatttagtgcatcttgttttatagacgatgtaagcaaaatttatagattatatgatggtcccctcgatgcacaaaggcaaatcctacttcaaactgtcggcatagaacaccatcaaatatgcaatcgttacagtgcaactgatttgatacgacgtaggttacgtcatgaaaaggcccttctgatttttgataatgtggatcaagttgaacaattggaaaaaatagctgtgcatcgtgaatggttaggtgcgggtagtagaatcgttatcatttctagagatgagcatatattgaaagagtacggagtggatgtagtttacaaagttccacttatgaatagtacagattcttacgagttattttgtcgaaaagctttcaaagttgagaaaattattatgagtgattatcaaaatttggcaaatgagatactagattatgctaaaggtctaccactagcaattaaagtattgggctcatttttgtttggtcatagtgtggctgaatggaagagtgcattggctagattgagagaaagtccgcataatgatgtcatggatgtgctgcacttaagttttgatggccccgagaaatatgttaaaaacgttctaaattgttgtggatttcatgctgatattggattaggagttctcattgataaatcacttataagcattgaggatgcaaatattaaaatgcattctttgttggaagagctaggcagaaaaattgtgcaagaaaattcaagcaaagagcaaagaaagtggagcaggatctggtccaaaaaacaactctacaacgttatgatggagaatatggaagagcatgttgaagccatatttttgaatgatgatgggattgatatgaacgttgaacacttttcaaaaatgagtaatcttagattgctcatcatctacaacaattcggcatggaattatacaacctataaaagaccttgctttcatggaaaactgagttgtctttcaaacaaattaaggtattttgactgggagcattatcctttctgggaattgccattaagttttcaccctaatgaacttgttgaattgatcttgaagaatagcagcttcaaacaactatggaaaagcaagaagtattttcccaatttgaaagcattggatctaagtgactccaaaatagaaaagataatagattttggagagttcccgaatcttgagtcgttaaatttggaaagatgtgaaaaacttgtggagttggattcatcgattggacttctaagaaagcttgtttacttgaatttggactattgcataaatttagtaagcatacccaacagcatattctgtcttagctctcttgaagatctatatatgtgtggctgttccaaagtgtttaacaattcaaggaatttgatcgagaagaagcatgatataaatgaaagtttccacaaatggatcattttgcccactcccacgagaaacacatattgcttgccatcattgcatagcttatattgtttgcgtcaagttgatattagcttttgccatctaaaccaagttcctgatgcaattgaaggtttacattcgctagaaagattatatttagcgggaaactattttgtgacactacctagcttgaggaagctttccaaacttgaatatttagatttgcagcattgcaagttgttggaatctttgcctcaacttccttttcctaccactactgaacaagattggtggattcgttcacaggatttttcgggatataggcggactaatcacggtcctgctttaataggattgttcattttcaactgtccaaaattggttgagagggaacgttgcagtagcatcacaatttcatggatggcacatttcattcaggcaaaccaacaacccaacaaattgtcggcgcttcaaattgtaactccaggaagtgaaataccaagttggatcaacaatcagagcgtgggtgcttcaatatcaattgatgaatctcctgttataaatgacaataacaataatattattggctttgtaagttgtgtattaatttccatggcacctcaagatacaacaatgatgcattgttttccactctccatctatatgaaaatgggtgctaagcgaaaccgtagaaagcttccagtgattatcgtaagagatcttattacaaccaaatcaagtcacctatggctagtctacttcccccgagagtcctatgatgtttatggaactctccgtgcgaaatgttatcagggtgaagttgtgggttttgaggtgaaaagttgcgggtatcgttgggtatgtaaacaagacctacaaaagttcaacttcacaatgatgaatcatgaaaattccttggctcagaagtgtaagattatggcaattgaaggcgagacacaaccacaaccagaacaagaatcattcatctcacaagtcataactacttcgaagaaagaagaaacaacagatggatcacaagaaggtcaagaagagtttcaacctaacacgtttggatttttaaaaaataaatctcaaacctctacagttgaagtggctgatgaaagtgtaacagaaaatgtagttgatcaaattgttgccgaatatgaacaacaatcacatatcgataatggaaaggaagatgattccgctgcaacacagacagacagtgatgcagttgagccttgccatgttatcacagaatcagaagatgacaatgttgaagatgttctagataacaatgagattgatgctagtttggccggacaaagtggtgattcatctcctgagggcagcatgaataaagatgtaactgaagaagtgcaagaagaacaaacacctgtcgcagcacatgttgaagaggttgcaattgcatctgagacaaacagcatatctaattctactgaagaaacagaaggctcgagtaaaggttttaatttcagtcgcccgatgatcatcttgtttttgtccctacctgtgttgaaattattagggatgtgggtacgaagagaagaaaaaacacatggattacaagaaggtcatcatgaagagtctaaaaaaaatggacaagaggagaggcatcgacatgatttacatctctaa

SEQ ID NO: 596 - DNA, 5013 bp, Medicago sativa
attatggccggggatcctcgtctataatactccacacagacacacaattactcacttcactcaaccatgtcttcttctccaagctcctcatatgaagttcctcatcctcatcatctttggatgttcgatgtgtttttgagttaccatgacaaatacattggtaaatcttttgcattggatctctcttccgctctcacacaagctggatatgctgtttatatcaacaatcacgatctcacaagcggagaacagagaaattcagctgcaatcaaagcgtgtagaacttccatcatcattttctcaagtaaatttgatggttcaacatggtttcttgaagaaatggagaagatattggagtgtcgtagaaccataaagcaggtatttgtgcctgtgttctatgatgttgatccctccgatgtactaaaacagaagggggtgtttggagaagcttttgtagattgtattgcacgaggcatcttgacagaagacagctcaatacgttatagagacgcgctctttgaagctgccaatatttcaggatttcggatgatggacaccaggagccaatataatgaaatcaatgacatagtgcaaggtttctgtcatttgatagaagaccaaaaatcgttattcattgctgaacatccggtgggagtagaagctcgggtgaaagatgtgattcaactattgaacagcgaacaagcagaaaataccatgattgtagggatatgggggatggctggggttggtaaaacaataattgctaaagccacttataatcaaatgagtttcacttttgattgcaagagcattctcaagaatgtcaatgaaacttgcaaatcgggtgatgatgggctggtttctttccagcgacaacttcttttagacatctgcaaaacaacaaagatacatatagatacagttgaatcaggaaagaagatattacagagaagcctttgccataagaaggtatttcttgtacttgacggtgtgaataaattggaacagttgaatgctttgtgtggtgatcgtgattggtttggtcatggaagtagaatagttattacaacaagtgataaacatatacttcgtaaccttcaacttgatcatgtgtatagaatgaaatatatggacaatactgaatctcttaagctttttagttggcatgcattcagaactccaagtcctaaagaaagttacgctgacctttgtagagatgttgttgagtactgtggggggttgccggtagctcttgaaatccttgggtcttatttgtttgacagatctgtacaagagtggaagattgcactccagaaattcaaaaccattctcccctatcaaattgagaaaaaattgagaaaaaatcttgatgtcttagaccatgacaaccaagatgtattccttaaaatagctactttatttattgggatgcacaaagatgatgtaattcagacattaaattactctgggcatttcccggaaattgcaatatcaatccttgaagataaaagccttttaactatagatggcaacaacaggattggaatgcatactttgttacgagcaatgggaagagaaatcataaggcaacagtcgatggatatggctgcgacaaagatgtacgacgtgttcttgagtttcagaggggaagactgtcgagcaaaattcatttcacatctatatatctctcttcaaaattccgggctttatgttttcaaagacgatgatgggattcaacgaggagatcagatctcagtcgcactaatccaagctgtcggacagtctaaaatttctattgttgttctgtctaaaaactttgctaattcaaaatggtgtatgacagagttggagagaattgtggaaatcagtagaaccaagggtatggtgcttgtgccagtgttctatgaggtagatccctcggaagtacgtcatcagacaggagagtttggaaaagcttttgaatgtcttctatctacaaaatcagtggatgaatacacaaagagaaattggaaagcagcactccatgaagttggtagcatagcaggggttgtcatcttaaaatccagcgacgaaagcgaggatatcaagaaaatagttgatcttgttactcatttgctagacaagacagaattatttgttgctgaccatccggtgggactagaatcacgagtacgagatgttattcaactactgagcagacaaaaatccaaagatcctcaactactagggatatggggcatgggagggattgggaaaacaacccttgctaaagccgtttacaataaaattcgtcatgattttgatgcaaagagcttcctgttcaatgtcagagatgtttggaaagtagacgatgacaaagtttctttacagcaacgacttctttttgacatctgcaaaactacaaagataaagatagactcagttgaatcaggaaaaaagatattacaggaaagactttgttcgaaaaagatatttcttgtaatcgatgatgtgaataaattggatcaattgaatgctttgtgtggagatcgaaaatggtttggtaagggaagtagaatactcatcacaacaagggatgatgatttactcagtaggcttgaagtcgaccatgtatacagaatgaaggaaatggatagcagtgaatctctagagctttttaattggcatgcattcaagcaatcaacatctagggaaggttttaccaacatttccagagatgttgtcaagtactctggaggattgccgctagctcttcaagtcattgggtcctttttgtcgactaagaaaataaaagcagagtggaaggatgtactggagaaactcaaactgatacctaataatgaagtgttggagaagctgagaataagttttgatggtttaagtgatgatgatgtgaaagatatattccttgatattgcttttttctttattggtatggaccgggaagacgtaactaagatactacaagactgtgggcatttttcagtaattgggataagtgtcctcgtacaacaaagtcttgtaactgttgataggaaaaacaagatcggaatgcatgatttgttacgagacatgggcagagagatcgtccgcaagatatcaaaagatgcggacaaggagcctagtagattatggcattatgaggatgtgcataagttgccaatagatactagttctttagctgtcaagggactgagtttaaagatgtcaagaatggactcaacaacttatttggaaaccaaagcatttgagaagatggacaagctaagatttcttcaacttgttggcatacaacttaatggagattacaaatatctttcaagacatcttaggtggcttagttggcatggattccctttaaaatatatacctgccgactttcatcaagatactctagttgctgttgtcttgaaatattccaatctggaacgagtgtggagaaagtctcaggatgaggattacgagtgcagagaactaagtaagattgcttcagagaaggttgagatgctgaagccatttctggtgaagctgaaaattcttaatttgagtcattctcacaacttgagacatacccccgacttttcaaaattgccaaatcttgaaaagttaatacttaaggattgtcccagtttgtcttcggtttcttctaatataggacatctcaaaaagattcttttaataaatttgaaagattgtacaggccttcgagaacttccaaggagcatatataagttagactcgctgaaaacactcattctgtctggatgtacaaaaattgacaagttagaagaggatatagaacaaatgaaatctttaaccaccttggttgcggatgacactgctatcacaagagtgccctttgcagtagtaagatcaaaaagcattgcatttatttctctatgtggttataaaggatctgcacgtagagtgtttccttctattattcagtcttggctgtctccaacaaataacattctatccctagttcaaacatctgcaggaactttatgtcgtgatttcatcgatgaacaaaataatagtttctattgtctatcatccattttagaagatcttcagaatactcaacgtctttgggtgaaatgtgattcacaagctcaacttaatcaaactgtagcaagtattttatatagcttcaacactcaaaattgtgagggattctcaaatattgagacttcagcatcaaattttcgtcgcactcaagtttgtatttccagctcaaaaaattcagtaacttcccttttgattgaaatgggagtgagctgcgatgtcgcaaacattcttagagaaaatattttgcagaaaatgcctcccactgggtctggtttgctccccggtgacaactatcctgattggctaaccttcaatagcaacagttcttctgtaactttcgaagtacctcaagtggacgggcgttctttgaagacaatcatgtgcattgcctattcttcttctctagacaatacaacaacagttggctttaaagttgtgttggtgataaattgcaccaaaaacaccattcatgtctacaagataggcgcattattatcatctttcgacgaggaggagtggcagagagtaatatcaaatatagaacctggaaacgaaattaaggtggttgttgtttttacaaatgaattcattgtgaagaaaacaacaatttatcttgtctatgatgaaccaattgaggaaaagacgaaccactgccatgagccagatgagaatggcattgtgtctagtggtgatgaaaatatatttggtagactcttcttcactattccttcccttgctcgagctgttctgatatcacggcctttctggttctgtttggctggtattatggtttggtcgtctagctgccgttctgacaagcgaacaagaaacaaccctattctaagggatgttgcatcgacgagctctcaaggattcaataatttagaatctttggacaaaaaccctttggatggtgtacaagatgtgaaaagacggggttaa

SEQ ID NO: 597 - DNA, 3295 bp, Medicago sativa
atggcagacgagctaactacgacaaaggaagaatcaaagaaagaagtaaagaaccgctgtatatttgtagttttctataagaagaagaataaggatgattttgattcatgtgttggagatgatgacgacaagcaaaaaatgggaaaagatgttgaaggtaagctgagagaacttcttaagattctagataaagaaaattttgggaagaaaattagtggatctattcttaagggtccttttgatgttcctgcaaatcctgaatttactgttggtttggatttgcaattgattaagttgaaggtggaaattctcagagaaggtagatctactcttttgttgactggtctgggtggaatgggaaaaacaactctggctacaaagctgtgtttggatgatcaagttaagggtaaattcaaggaaaacattatatttgtaaccttctcaaaaacacccatgctgaagattattgtagagagattatttgaacattgcggatatccggtgcctgagtaccaaagtgatgaagatgcggtaaatggattgggacttttgctgaggaaaattgagggaagtccaatattgttagtcctggatgacgtttggcccggatcagaagacctagtcgagaaatttaaatttcagatatcagattataaaattttggtcacttcaagggttgcattttctagatttgacaaaacatttatcctaaagcctcttgctcaagaagattcggtaacccttttccgtcactacacagaggttgaaaaaaacagttcaaaaattcctgacaaagatcttatcgaaaaggttgtggaacattgcaagggtttaccacttgccattaaagtgattgcaacatcattccgttatcgaccatatgagttatgggaaaagattgtaaaggaactttcacgaggtcgttctatacttgattctaatactgaattacttattcgcctccaaaagattttggatgttttggaagataatgccattagcaaagagtgcttcatggaccttgcattatttcctgaagatcagagaattcctgttgctgccttgattgatatgtgggcagagttgtatggactagatgatgacggcaaagaagcaatggacataatcaacaaattagactctatgaatttggctaatgtcttaatagctaggaatattaacttctgttcaattcccaggaaaaatgcaagtgacacagaaaattactactacaataatcacttcatcgtccttcatgatctgctgagagagcttgggaattatcaaaacacccaggaacctattgaacaaagaaaaagacagcttattaacacaaatgaaagcaaatgtgaccagaggctcagggagaagcagcaaggtacaatggcccacatattatccaaattgattggatggtttgataaaccgaagcctcagaaggtccctgcccgcacattgtctatatcaattgatgaaacttgcgcttcagattggtcccaagtgcagccagctcttgctgaggttctgattttaaatcttcaaaccaaacagtacacatttccagaattgatggagaaaatgaacaaacttaaagctcttatagtcataaatcatggtttacgcccttctgaactgaacaatcttgagctacttagctctttatccaaccttaaaagaatcaggctagagaggatttctgttccttcctttggcacattgaagaatcttaaaaaattatccctctacatgtgtaatacaagactcgcttttgaaaagggcagcatcctaatttccgacttatttcctaatttagaagatttgagcatggattattgcaaggatatgacagcattgcctaatggggtgtgtgatattatctcgttgaaaaagctcagtattactaattgccataagctttctttgctgccccaagaaattggaaagttggagaatttggaactcttgagcctgatttcctgcactgatttggtagagctaccagattctattggaaggctttcaaatctaagactacttgacatctccaactgcataagcctttcaagtttacccgaggactttggcaatctgtgtaatctacgaaatctcgacatgactagttgtgcaagttgtgaattgccattctccgttgtcaatcttcagaatttaaaggtgacatgtgatgaagagacagctgcttcatgggaatctttccaatctatgatttccaatttaactatagaagttcctcatgttgaagtcaatttaaactggcttcatgcaaatcgctcctaaaacctacgtgcactcttcctttgccttttcaagttgtcgttgaggacattgaagccgatagaccaaaatactccgttttctgctttggaactcgtcaacatctagggtcattcaaatattgattctagtagcaagtaatgtgcctacatgtctcaaaaaaggcttcatgtttacgatagataggaaggcaggaagtaataaaaaaacaaaacagtctgaaaatgaagaatgatggtgatactgatgcactaaggcacatggaaagaaaatgaaatcatgataagtatgatggttaagcattggtttggagtaaaaagtggccaaggaagaggtaaaggtgttagtaaatgtgtccccctgtgaaactgaaacattgtctagtagtattttaggtaaattctaggctgcctttgaaaagttgtggataagttacgcatatatcaattaaaaacagccgcatgtactcctaatgtttttcttcaaaaattacatgtttgatatatattatggagtacatgtgactgattttaattggttgtgagtaatttatccacacctttttaaaggtagcctagatctcgctgtattttaagtttttaacgttaataagttgatgtgtcaaagttgctgaagttgtgcaaaggcaaatcctcattttaatccttctaatttatgacttgaaaatgtgaaataaatttctgcttcaagttatttcctgaagacacgaggatcctctgctgctatggacagaaatccatgatgaagatgatttgagtgcagtggagaaaattcaagccagggtcaaatgtcatgtttggtattttatttttattttttgttttgtttggtttgtataatagtactagtggagtggctcttaaacaatttgtgatattatgtgtgattttctgaaaaagccactaactgcaagttgtgtaaaactatggttatgaaataaaactgtttgatatttctgtttggcaaaaaaaaaaaaaaaaaa

SEQ ID NO: 598 - DNA, 4507 bp, Medicago sativa
agtctagccaataacatttagttcattcatagccgttgtgggagtgggactcaccacacacatttgaatccaacatcaatacttctcagctactgctacttccatagttgtctgcaaaatctactctgaaaccttcccatttatctttcatcttctgctgctttgacagggcagcatcatacgaagttttagacttcttaatactcgacattagctctttgctttcagtaatcttatttttagcctcatcttccaatttcttcttttcatcttcgtgtctttccatgctttcctttaacttgattttttccaactcaatactgttcttttgctcaacaagtattctaattttttcctccaccttttcaccctcttccacgagacgcttggcttcatcctcaaactgactcttttctttcatcattgatttcttctgtttcttaccatctctcattagctgcacaagcttttctctttttcgcaaagcattaatgtgatcctcaaccacatttttagtcatgacaaagtttttggaaaggttctgaataaaggatgtcattttctggacaagcttcacaacgtttggagaaactttttcattggttgctagttttatgcattccaatgacgtgtgtaattgttgttgtagctctacgtcatagagaatggactctagtgaattttcaaataggcattcaaggttgtgcaaagcttcttttacagcaacatcatcacttgtggaacaggttacttttggcggagactctggacttcccagcaggatgctctcaagttcagcaaaagggtcctcatctgattcatcttcaaagtttcttagatccattggtgaattttctttacttattggatcagtggtgtcgggaacaataacctgtccttgtatatttggttttccttctgattgcttggtctcatcaaaattgtctttcccatcatagttgttttcacttgacttgttatcagaagtgttgccttcaaacgctgacattaccggcagatacaatccagcttcagattcagttggtcttccttcatttcctttgctttcgaagacttttgcggaatttgtaatattctcctcatgactggttccagcattggtattggtttcgttgttagaagatctgatgctcttttccacattaaagaagtgactttcaagttcaactgattctagtttaaccattgctgatctttgttcttgaacaattggcttcaaggttatcctacgtcctgattctaattccaccgccttcttcaactcttctttcttttgtgaatccaattccggcaaaacactctccaattcttgaacacttactagtcgtaccccacactctttaataccaactgaaccatcaacttcccggccagtatcgtttgtaacatagaactcgaaacaaatctcgggttgataaaatttgagaatactgtcacaatggaatggatcataccacacataaacatgatccgagttcagttctgtgacatcagtatttagccaggtagcttttataccttcttctcccaagttgcattgacactttatcctagctcctccacccttcattccatttccacctgctggagaaagaaccactgagtatatgaatcccagcaagttggaacgatcaggaagcaatgtaatggtaatggaagagtcagaagctgttagacattggaatagcctcgggatacttgttcctagttgacaagcatcaacactgttatagttgtagctgcggacggccacacggagtcttcttacagacacattatgaaacacagcactcatcattgttaaattgagactttccattataagtccaagtgaatgtccgtccaaattcaagctgttgctgaatgaaatatgtttggtttttccgatcatctttgttgctaatttttttagatttgacactgaaaccagcgatgtgcagttaactgcatttaacagtgtgattagaggtggaagctctggtatgcactcaagcttcctgcaattcaccaaagacaaaatttccagttcttcaagtttcttaatgctttgaggcaacattttcatgttgcttccatcaaggtttaattccattaactttgatgcaacgtggacgttgttggggagttcaaactggtttataaaatccttcatatgtagtatttgtagggattgtaagccatcaaacaactcatgtagctgttttttctcaactattagtctactgccagaaatcttcaattccctaatagatctcacactagataactccttcggaatacggttgagtcttaaactctctagattaagttgtttgagtttttgaagacgtccaattgataggtccagtgttttgattcctgtactgcttaaatccaagttttcaattaaatccgaggacactgcaaattcctccagacttttgcacccatccacactgatcttctccaaaaaatttaaatgtttttcacctctaaccctcctaacctttgtacacctatccagtatcaaagtaacaagtgtatctgcgcataaaacagatggatgaagatcaaccagactctcacaaccagaaagattaacccatttcagacttgacgccttagaaaaattcggaagcttttcaaattgcttgcattcactaaggtcaattccctctaatttacccagttccttcgtcccctgccacagttgtttaacattgctgtgcggcatacggatctcaacaagaaacttggcataaaaatgttgtggaagagattcaaaagggtatccattccactcaaaatacctcagtttatttgaaaatggctcaagaaatttgggaaggttgaggtatgtgttagtacatctctgcaggttagagggtgcatggaatttaagaattcttaaggctttcatcttggtgaatgtgtcggcacttaaaggcaaatcattattttgtgacaaatccaatgttatgccttcaattgagctactccccttgttttcttcaataactgcacgagctttactcccactcagtcgggtatgtgctgccgggtcctcgccacaatcattacatattatgtccgaacccattttttgcagtaagtcatgcatttgtattgtttggttatttgagatagttatcaaagccttgtctttgaggactactattccgctatttggttcgaaaccacaagcatctagtatctttgtgacagactctttcttttctcctatgaagaagaatgcaatgtctagaaatatcttcttctctagtgcatctagttcatcgtaactcacttttaaaactttgtgcaatttgtcatcacgatgatcatcgagtttcttaaaagaactttcccaaaatgcaatatctcttgtacgaagatgtaaagccaaaagtttaagggcaagcggaacgccccctgcataagtgattgccctttgcaaaagatgctcatacttctctcggggattacttggctcaaaggcttctaggcaaaaaagctctagagattttggatattcccactgcttgacctcatatatccaatcaactcttccactcagcaactgtctgtctctcgttgttataatgagtctactatctttatttagctcgccgtaatctctgcacaaatattcaaactgatctaagctgtccatattatcaagtacaatcaaaacttttctacttctcagcctcctcatatgaaatgcagatcctacattagatggggaaatttcttcctttagtagctcagagaaaagcttactaagtgaatattcttttgcattagcaaagcagacatgatcatattgggcaaacagcttggcaaacaagactttagcaatgattgtttttcccattccacccataccccaaattccaagtcttggaaaacgttccaccaatgattcaacctgttcacagtttttttcgtttctcactacaccttctagttcattagggtacctcagttgtagcttttgcaatacatcattcacaattttgtcgatgaggatagattcttccttgtgggtttgagtgtgccatccagatatagtggctgcttcagccaaggcaactttccagttaagcactttaagatcattggtcccaagatctcgctcatgttttgcgaatgcattctcataactgccagtctgatttcttatgtcagatggatctgttttatagaaaacaggtataacaacttgacctttgacttttctgcattccagtactttgaccagttcttccaaacaccatgttgaggtagcaaaattttcagagaaaacaacgatggaaacatgtgattcctcaattgctttggcaagagttggccaaatatcttctcctctttcaagcaggctatccacgtatgttttgattgatttatgaatcagagcagcgtgaagatggctagtgataccgtagcgagtgtcctcgcctctaaagctaagaaacacatcgtgcttcttgctagaatatgacat

SEQ ID NO: 599 - DNA, 1932 bp, Medicago sativa
atggccgatcaacaattctcctcgacttcctatacctacgatgtgttcataagctttgaaggtttcgatactcgtaacggttttacaggccatctctggaaagctttgaatgacataggaatcctcgccttcatcgatgacacggagttttccaggggggaagaaaccaaaccggcaattttcaaggccattcatgtttctcggattgccattattgtgttctcagataactatgccgggtctaagtttctcttggaagaacttgcatttatcgtggacaactttcagcagagtgacaaccttcgatttattgttccggtttattacaatattgaagcttctcatgtgcgacaccaaagtggaccttttgaagctgcattcgtaaagcacgaggagaggttccatgaaaacagggagaaagtgcttaaatggaaaaccgctctatctcaagtagctaacttgcccgggtggcatttcgacgggttgaatgaagatgaagatgagggaagaagaagaggaggaagaaaggttgagtatgaacatcagtttctccagaagattgtgaaagagatctccaggaggttggatcgtgctcccttacacgttgccgattacccagttggattggattctcgattgggagaagttttccggcatttggagttggaatctcatgaagtccttacggtggggatctatgggattggcggaatagggaaaacaacacttgctcgagcagtttataatacgatttcggatcaatttgaaacctcgtgttttctttccaatattagaaaaagttcaaatacacaaagtttagcgcaccttcaaaatatacttctttcagaaatgactggattgaaagatattcagttaaaagatactagtaaaggaatttccgaaataaagcacaggctctaccgaaagaaagttcttctcatcctagatgatgtggacagactagagcaaatggaggctttggctggaggacttgattggtttggtcctggtagcagagttgtcattacaacacgggataggcatttgctagcatttcgcggggttgagagaagatacgaagtacaagagttaaatgacgtagatgctcttgatttgcttagccacaaggtttttaaacaaggcattgttgatccaaattacacagaacttttaaaccgagcagtaacttatgcttccgggcttccattggccttggaagtaataggttcaagcttgtttggattaagcgttgaccaatgtgaacatgcattaaatcagtttaaacggattcttcctaaggatattcaaaaattacttagagtaagttttgatgctttggatcaagaggtaaagaacatatttcttgacattacttgttgcttcaaaggatatgccttggcagacgtcgagcagttactttgtgctcgttatggccacgacatgaaatatcatattaaagtgttgattgacaagtcactcataaatattttagatggtaaggtgacaacaacacatcccttgatagagagcatgggtaaagaaattgttcgtgaggaatcaccagaagatcctgggagacgtagtagattatggttctctgaagatatagttgaagtcttgaaaaataataagggaacaagtagtattgaaatcatacacttagattcccccttaattgaagatgaagaagcaatagaatgggatggaaaggcttttaaggagatgccaaacctcaaaatactattattagaaaatgttcgacttgcggatcctgaagtttttaatctatcatggagagtagttggccttatgtcaagtatagtcggtctggccaatccaattgttgatagtggtggtcaagctgttgatcaatcttcacattccaatccaaatgttgatagtggcgatcatcatctcattgacattcgttag

SEQ ID NO: 600 - DNA, 648 bp, Medicago sativa
  misc_feature (24)..(24): n is a, c, g, or t
  misc_feature (589)..(589): n is a, c, g, or t
ctgattcgccagctcgaaattaancctcctaaagggaacaaaagctggagctccaccgcggtggcggccgctctagaactagtggatcccccgggctgcaggaattcggcacgaggagacgttaaaggatcatgttgaaatccttgaggctgcaagagaaagaatgatccattcagttaaaagtgaaagggaaaatggtaaagaaattgaaaaagatgttatgaattggttggagaaagtggatggggtcattaaagaggcgaatcaacttcaaaacgattctcacaatgcaaatgttaggtgctcaccatggtcattcccaaatttaattttgcgtcatcaactaagtaggaatgccacaaaaattgcaaataatgttgttgaagttcaagggaaagaaaagtttaattcatttggtcaccttcctcctctagatgtagtagcctcctcctcaacaagagatggtgaaatgtatgacacaagggagtctctaaagaaggacattgtgaaggctttaggagattctacttcatgcaacattgggatctatgggttgggtggggttgggaagaccactctggtggagaangttactcaaatagccaaggaacataatttgttcgataaagtggttaaggcagaagtatc

SEQ ID NO: 601 - DNA, 999 bp, Medicago sativa
tgatacgccaagctcgaaattaaccctcactaaagggaacaaaagctggagctccaccgcggtggcggccgctctagaactagtggatcccccgggctgcaggaattcggcacgagggtttcacactcctagaggaatctttatagataatctttgaaaacaaataatttagcatattcatcttcctaaagataacattgattcatatcctcactgtccaaattttggttcatttctgttctcgtacctacaaaatgactgatgttttacttggaatcgtgattgaaaacctcatatcttttgttcgagaggagctttcgacctttttgggtgttggagaattgactcagaagctatgtggaaatctcaccgcaattcgtgctgtcctccaagatgctgaagagaagcaaataacaagccgtgctgtgaaagattggctgcagaagctggctgatgctgctcatgttcttgatgatatattggatgattgttcaacaacatcaaaagcacatggagacaacaagtggattgcccgtttccatcctaagaagattttggctcagcgtgccattggaaagaggatgaaagaggttgctaaaaagattgatgaaattgccgaaggcaggatcaagtatggattacaagtgaaagtcacggaggagcaccaacgaggagatgatgaatggcggcaaactacttctgtcatcactgaaccgaaagtctatggaagagatcatgatatagagaaaattgtcgaggttcttgtaagccatgctatcgatagtgaagaactctcggtctactccattgttggagttggtggattgggaaaaacaacgcttgctcaagtggtcttcaatgacgaaaggcttgatacactttatgaacgtttaacaaacatgaaactatcttcttcttcttcaatgatgaaaattctggagtccatcataaaatccaccgttggaaaaaatccataactctcgtctttagaatcaatgc

SEQ ID NO: 602 - DNA, 3687 bp, Medicago sativa
atggcatctctcacagatcgtttcaaatatgacctttttcttagcttcagaggcgaagatactcgccatggtttcaccggcaatctttggaaagcactgagtgacagaggaattcacaccttcatggatgatgaagaacttcaaaaaggcgaagaaatcacaccatcactcatcaaagctattgaagattccaacatggctatcatcgttctttccaagaactatgcatcttcaaccttttgcttaaaagaactatccaccatcctttattcgattaaagataagggtcggtgtgtttggccggttttttatgatgtggaaccttctgatgtgagaaagttgaaaaggagttatggtgaagcaatggttgaacatgaggcaagggatcatagtaacatggatttgttgcagaaatggaagaatgctctgaaccaagttgctaatttgtctggctttcatttcaaaaatggggatgaatatgaacatgtttttattgggaagatagttgaacaagtctcaagggagattatacctgctactttacctgttcctgattatctagttggactcgagtaccaaaagcagcatgtaacatcccttttgaatgatgggcctaatgataaagtccaaatggtagggatccatgggattggtggaatagggaaaactacccttgccctggcagtttataattccattgtccatcaatttcaaggttcctgttttcttgaaaaagttagagaaaattcagacaaaaatgggttgatacatctccaaaagatccttctatctcaagttgttggagaaaagaacattgagttaacaagtgttagacaaggaatttcaatattacaaaaaaggttccaccaaaagaaggttcttttgcttctagacgatgttgacaaggaggagcaattagaggctattgctggaagatctgattggtttggtcgtggcagtagagtcatcatcaccactcgggacaaaaggttgctaacatatcatggggttgaacgtacatatgaggtgaatgggttgaatgaccaagatgcttttgagctagttatcttgaaagcttttaaaaataaatttagtccaagctataaggatgctttatttgcacagtatggtagtctattggatgtgaacaaattgcctagactgaaagcttttaagactgacgaagttttttcaggttatgtgcatgttatattacgtgccatatcatatgcttctggccttccactggctttggaagtcataggttctcacttttttaataagacaattgaacaatgtaaatatgcattagatcgttatgaaaggattcctgataaaaagatccaaacgatactacaacttagctttgatgctttgcaggaagaagagaagtctgtttttcttgacattgcctgctgcttcaaaggatataaatggacaagggtagaacaaatacttaatgctcattatgataatatcatgaaagatcacattgatgtgttagtggaaaaatctctcattaaaacaagtatgtctggtaacgtgacattacatgatttgatagaggatatggggaaagaaattgttagacaagaatcacctgaagatcctggaaaacgcagtaggttatggtcctctaaagatataattcaagttttagaagaaaatacgggaacaagtaaaattgaaatcatatgtccaagctcccggattgaagtagaatgggatgaagaggctttcaagaagatggaaaacctcagaacactaattattatggatggccaatttactgagagtcccaaaaatcttccgaacagtctaagaatacttgaacatcacctatatccttcatggggtttaccgtctcaattttatccaagaaaacttgccatatgcaagattccgtcttactctacatcattcgcgtgggatgactttttcaagaaggcaagtaagttcaagaatataagggttttaagttttgatcaccacaaatctttaacacggatacctgacatatctggtctcgtaaatttagaagaactttcttttcaagattgtgtgaatttaatcacagtcgatgactccgttgggtttctgggtaatcttaaaaccttaagagctatgcgttgcatcaagctcaggagtattccgcctctcaagttggcttctctggaagaactcgatctttcacagtgttcttgtcttgagagttttccacctgtggtagatgggttggtggataaacttaaaaccatgactgttagaagttgcgtcaagttaaggagtattccaactcttaagttgacttcgttagaagaactcgatctttcaaattgttttagtctcgagagttttccacttgtggtggatgggtttcttggaaaacttaaaatcctacttgttaaatattgtcgcaatctcaggagtattccacctctcaggttggattcattagaaaagcttgacctttcacattgttatagtctcgagagttttccaactgtggtggatgggttgttggataaacttaaattcttgagtatggaacattgcgtcaagcttacgagtatcccatcgctcaggttgacctcattggaacggttcaatctttcacattgtctgagcctagagagatttccaaaaatattgggagagatgaataatataacagaaattcacttggataatactctcatacaagaattgccgtttccatttcaaaatcttactccgcctcaaacattatatcaatgtaactgtggagttgtttatttatcgaatagagctgctgtgatgtcaaaactggctgaatttaccatccaggctgaagaaaaagtgagcccaatgcaatcttcacatgtagaatatatttgtctgaggaactgcaaattttcagatgaatatttgtcaacgggtctcatgttgtttactaatgtgaaagaattacacctaagtgataaccaattcaaaattcttccaaaatctatcgaaaaatgtcattttttacagaggcttgtcctggataactgtgaggaacttcaggaaattgaagggattccaccatgcttaaaaacattatctgcattaaactgcaaatcattgacctcaccgtgcaaaagcaaattactaaatcaggttaaacttacattaataatttatgactaccaggaattacatgaggcaggaaacacttggttccgtttgccacgaacaaggattccagagtggttcgaccatcaatgcttggcaggattgtctatttctttctggttcaggaacaagtttcctgtcatagctctctgtgttgtttctccatcgacatgggatgattctaggcgtcctgtaagagtgatcatcaatggtgatacatttttctataggcatggtgaaaataaacgtttatcaccagaagtgtatcatctacatctttttcatatgcaaatggaaaaattgaataataatatggacaaagcacttttagaaaataagtggaaccatgcagaggttgactttgggttcccattcatgtatagtggaatccatgtattgaaaaagaaaagtaacatgaaggatattcaattcaccaacccagataaagatgataatattgagctcactcaatataaacgaaactctgattcattggtctcagtcattgcttctgatgtggataaatgtgaatga

SEQ ID NO: 603 - DNA, 2118 bp, Medicago sativa
atggcagacgagctaactacgacaaaggaagaatcaaagaaagaagtaaagaaccgctgtatatttgtagttttctataagaagaagaataaggatgattttgattcatgtgttggagatgatgacgacaagcaaaaaatgggaaaagatgttgaaggtaagctgagagaacttcttaagattctagataaagaaaattttgggaagaaaattagtggatctattcttaagggtccttttgatgttcctgcaaatcctgaatttactgttggtttggatttgcaattgattaagttgaaggtggaaattctcagagaaggtagatctactcttttgttgactggtctgggtggaatgggaaaaacaactctggctacaaagctgtgtttggatgatcaagttaagggtaaattcaaggaaaacattatatttgtaaccttctcaaaaacacccatgctgaagattattgtagagagattatttgaacattgcggatatccggtgcctgagtaccaaagtgatgaagatgcggtaaatggattgggacttttgctgaggaaaattgagggaagtccaatattgttagtcctggatgacgtttggcccggatcagaagacctagtcgagaaatttaaatttcagatatcagattataaaattttggtcacttcaagggttgcattttctagatttgacaaaacatttatcctaaagcctcttgctcaagaagattcggtaacccttttccgtcactacacagaggttgaaaaaaacagttcaaaaattcctgacaaagatcttatcgaaaaggttgtggaacattgcaagggtttaccacttgccattaaagtgattgcaacatcattccgttatcgaccatatgagttatgggaaaagattgtaaaggaactttcacgaggtcgttctatacttgattctaatactgaattacttattcgcctccaaaagattttggatgttttggaagataatgccattagcaaagagtgcttcatggaccttgcattatttcctgaagatcagagaattcctgttgctgccttgattgatatgtgggcagagttgtatggactagatgatgacggcaaagaagcaatggacataatcaacaaattagactctatgaatttggctaatgtcttaatagctagggagaagcagcaaggtacaatggcccacatattatccaaattgattggatggtttgataaaccgaagcctcagaaggtccctgcccgcacattgtctatatcaattgatgaaacttgcgcttcagattggtcccaagtgcagccagctcttgctgaggttctgattttaaatcttcaaaccaaacagtacacatttccagaattgatggagaaaatgaacaaacttaaagctcttatagtcataaatcatggtttacgcccttctgaactgaacaatcttgagctacttagctctttatccaaccttaaaagaatcaggctagagaggatttctgttccttcctttggcacattgaagaatcttaaaaaattatccctctacatgtgtaatacaagactcgcttttgaaaagggcagcatcctaatttccgacttatttcctaatttagaagatttgagcatggattattgcaaggatatgacagcattgcctaatggggtgtgtgatattatctcgttgaaaaagctcagtattactaattgccataagctttctttgctgccccaagaaattggaaagttggagaatttggaactcttgagcctgatttcctgcactgatttggtagagctaccagattctattggaaggctttcaaatctaagactacttgacatctccaactgcataagcctttcaagtttacccgaggactttggcaatctgtgtaatctacgaaatctcgacatgactagttgtgcaagttgtgaattgccattctccgttgtcaatcttcagaatttaaaggtgacatgtgatgaaaagacagctgcttcatgggaatctttccaatctatgatttccaatttaactatagaagttcctcatgttgaaccgatagaccaaaatactccgttttctgctttggaactcgtcaacatctag

SEQ ID NO: 604 - DNA, 3642 bp, Medicago sativa
atggcttccctcacagtcacatgtcgcttcaagtacgatgtttttctcagctttagaggcgaagacacccgccacggtttcactggcaacctctggaaagctcttgatgacaaaggagtcagaactttcatggatgacgagaatcttcagaaaggggatgaaatcacaccgtcacttattaaggcaattgaagactcacaaatcgccatagttgtcctctctaagaattatgcttcatcatccttttgcttacaagaactttcaaagatccttgataccatgaaagataaggtgggtcgttttgttatgccagtattttataaggtggatccttctgatgtacgaaagttgaaagggacatatggagatgcgatggataaacttggcgaggccagctcctccagtcataataaatggaaggactctcttcatcaagttgctaatttgtctggatttccttacgagaaaagggatgggtatgtgcatgagtttattgagaagattgttgaagaagtcttaagaaatataaaacctgttgccttacctgctggtgacttccttgttggagtggagcaccaaaagcaacacgtgactttgcttttgaatgttgggtctgacgattcaatccacaaggtagggattcttgggattggtggaatagggaaaaccactcttgctctagaagtttataattcaattgtcagtcaatttgaatgttcctgttttcttgaaaaagttagagaaaattctgacaaaaatgggttgatatatctccaaaagatccttctatctcatatttttggagagaagaacacagagataacaagtgttggagaaggaatttcaatactaaaaaaaaggcttccagaaaagaaggttcttttgcttttagacgatgttgacaagaaggagcaattaaaggctattgcaggaagttccaattggtttcgtaaaggcagtagagtaataatcacaactcggtacaaaaatttgctaattagcagtggagttgaaagaatatatgaggtgaagggattgaatgatgaagatgcttttgacttggtaggatggaaaactttaaaaaacgattgtagtccacgctataaagatgttttattagaacaaaagtatggaagagaatctgatgcaaacaaattgcgtagactgaaagatttgaagaacgacgaaggctacgcaaatgtattaaaacgtgtcgtagcatatgcttctggtcatccacttgctttggaagtcatcggttctcacttttctaataagacaatagaacagtgtaatgatgcactagatcgttacaaaagagttcctcataacatgatccaaacgacactacaactgagttatgattctttgcaggaagaagagaagattgtgtttcttgacattgcatgttgcttcaaaggatggaaattgacaatggttgaaggaatacttcatgctcatcatggtcataccatgaaagaccaaattaatgtgttagtggaaaagtatctcataaaaataaatgagtctggtaatgtgacattacatgatttggtagaggatatgggaaaagaaattgttagacaagaagcacctgaagatcctggaaaacgtagtaggttatggttttccgaagatataattcaagttttagaagaaaatacaggaacaagtaaaattgaaatgatacatttcgacggtgtgattgaagtacaatgggatggagaagctttcaagaagatggaaaatctcaaaacactcatttttagtaatgataagttccagaatatgagagttctaaaactttattatagtgacggtttaacacagatacctgatatatctggtctcccaaatttagaagaattttcaattcaaaattatgggaaattattcacaattgatgaatcggttggatctttgcgtaagcttaaaatcctgagggttataagttgcaccgaaatccacagtcttccatctctcatgttaccctctctagaagaacttgatctttcatattgtattaatcttgagagtttttcgcatgtggtagatgggtttggtgataagcttagaaccatgagtgttagaggatgcttcaagctaaagagtattccacctcttaagttggattcactagaaacaatggacctttcatgttgttttcgtctcgagagttttccacttgtggtggatgggattcttggaaaaattaaaactctgaatgttgaaagttgtcacaatctcaggagtattccaccactcaagttggattcgttagaaaaacttgacatttcatattgtggtagtcttgagagttttccacaagtggagggaaggtttcttggaaaacttaaaaccttgaatgttaaaagttgtcggattatgataagtattccaactctcatgttaagtttgctagaagagctagatctttcgtattgtcttaatctcgagaattttccacttgtagtggatgggtttcttggaaaacttaaaaccctgagtgctaaaagttgtcgcaatttaaggagtattccatctctcaagttggatttactagaaacacttgacctttcaaattgtgttagtcttgagagtcttccacttgtggtggacgggtttcttggaaaacttaaaaccctacttgttacaaactgtcacaatcttaagagtattccacctctgaagtgtgatgcactagaaacacttgacctttcatgttgttatagtcttcaaagtttttcacttgtggctgacagattatggaaactcgtgttggatgattgtaaggaacttcaggaaattaaagtgattcctccatgcttaagaatgttatctgctgtaaactgcacgtcgttgacttcttcgtgcacaagcaaattactaaatcaggaattacataaggctggaaacacttggttttgtttgccacgggtgccaaaaattccagagtggtttgaccacaaatacgaggccggattgtcaatttctttctggtttcgtaacaagtttcctgccatagctctctgtgttgtttctccattaacatgggatggttctcgacgtcattctataagagtgatcatcaatggaaatacatttatctacacagatggtttgaagatgggtacgaaatcaccgctgaatatgtatcatttgcatctttttcatatgaaaatggaaaactttaatgataatatggaaaaagtactttttgaaaatatgtggaaccatgcagaggttgattttggattaccattccagaaaagtggaattcatgtatcgaaagagaaaagtaacatgaaggatattagattcaccaatccagagcctgcaaaaagagtgctcgcctttacactcacagaaggcggtgatgatttggacaatagagtagacatgtcaaaattaaaccaagcagaggatgtagaagagagccttagtcattccttttgggaaaccaatgtagatcaaactggtttggatgcatcggataacactccttcatcattggtggaactggttaatgtgattgactatttggaaggcggtttcttctggctttgcagtgtcaagaatgcattagatttggactcggttctatcaagacttcacagcaatgtgatcaaagaagatgaatga

SEQ ID NO: 605 - DNA, 576 bp, Medicago sativa
atgggattggtggaatagggaaaactactcttgctctagaagtttataattcgattgtccatcaatttcaatgttcctgtttttttgaaaaagtcagagactttaaggaaagtgggttgatatatctccaaaagatccttctgtctcaaattgttggagagacgaacatggagataaccagtgttagacaaggagtttcaatattacaacaaaggcttcaccaaaagaaggttcttttacttctggatgatgttgacaaggatgagcaattaaaggctattgctggaagttccgaatggtttggtctaggaagtagagtcatcatcacgactcgggacaaaagattgctaacatatcatgggattgaaagaagatatgaggtgaagggattgaacgatgcagatgcttttgacttggtgggatggaaagctttaaaaaattattatagtccaagctataaagatgttttattagaacaaaagcaaggaagagaattgaatgcgaatgaattgtgtagactgaaatatttgaagaaagatgtacgtttttcaagttatgcgaatgtttataaaacgt

SEQ ID NO: 606 - DNA, 683 bp, Medicago sativa
  misc_feature (634)..(634): n is a, c, g, or t
  misc_feature (682)..(682): n is a, c, g, or t
gcaccaggccgtctaaacgctaatagcggtaaagagaatgataagaaactaaacaaagttccttttattaaaacatctatggtaattatatttcttaattcatttttcaaaatctcaaacaacaaacaaagcatagcacaatttgagcgattttgccccgttttcctcctttgtaatttggtagtctccttcctcagtttcatccaaatatatattattgtgacatcatttattaacttaacactcaattaatgattttcctttaaaatttaaaaataaaactcaaaaaaaatgtcaaaatgtaaactcctaaaaaaatggagacggcaattgtacggtcgctgtagatagaggatgaaaaacacaattaatcctaatatatgcacttgaatgacctcttttctcatattggacagggatatgcctgagcataagtttattggggagattgttgaaaaagttttaggaaatatagaacctgttgcattgcctgttggtgattacaaagttggattggagcaccaaaagcaacatgtgatttcccttttgaatgtttgggtcggatgataaagcatgtatggtagggatcctacgggattggtggaatagggaaaacaactcttgctatttctgnttataatttgattgccaatgaatttgagggttcatgttttgttgaaang

SEQ ID NO: 607 - DNA, 2838 bp, Medicago sativa
atggcagaaactgcagtatggtttgtcttgagacaagtataccaacttctaaaagatgaaacaagattactaaaacatgtccgtagagactttgaagacgttaagaatgaactagaattcgttcgcgctttcttaaaagatgctgataaaagagccacttcggatgaagtaagcattcaaatttgggtgaaacagttaagagaattatcttttcacatagaagatgtcattgatgcatacatcatggatgtggctcatcaccatcatcatgatcatcatgatggattcataggcaaacttcataatgttgttggattgatgaaatggaaaaccttaaaacctcgtcatcgagtagcgtgtgagattcaagagatcaaattaacaattcatggaatcaaagaaagaagtgaaaggtacaattttcaacgctctgaacaacgaggatcgtcgattgtagaagattgtgttatggttaagtggcgcgatcctgatcgacttgcttcactttttgttgaagaaggtgaaattgttgggtttgagaagcctagagacgaaattgttgattggttggttgatgaagaagaaagaactcggagtgtgatttcggtggttggaatggggggacttgggaaaacaactcttgctaaaaatgtttttgataatcaacaactgaaaggttactttgattgtcgtgcatttctggtggtttctcaatcgtatagtgttgaagccttgttgagaagcatgatgatgcagttttctgaagaaactaaagagcctcttcctcaaggtataaacacgatggacaagacgtcactcattaattttgcaaggtcttacttgaagaataagaggtatgtggtttactttgatgatgtatggaaagtagatttttgggatgagatccaacttgccacaccagataataagttaggaagtaggataatgatcacaaccaggaatttggatgttgccaactattgtaggaaagattcggttgttcaagtgcacaagttgcaacccttgtctccaaacaaatcatgggaactcatttgtaacaaggcgtttcgatttggtttcagtggaaattgtccaccagagctcgaagatatgtctaaggaaattgttcaaaaatgtgaggggttaccgcttgcaattgtggctataggaggtctcttgtcaactaaagataaaactgtttctgagtggaaaaaactatgccaaaatctaagttcggagttagaccgtaatccacatttagctaatataacaagaattttaggcatgagttatgatgacttgccacattatttgaagtcatgtgtcttgtattttggtatatacccagaagattactcaattcggagttcaaggttgattcggcaatggatagcagaggggtttgttaaacatgaagtgggaaaatctttggaggaagttggagaggaatatttgacagagttgatccacagaagtttggttcatgtctcccgtgttcactatgatggtaaagcgacaagctgtcgaatccatgatttgttacgagaaatgatcatgagaaaaatgaaggatttgagtttttgtcatgtgatggatgaagatggtcatgaacaaatctctgatgcaatgattattaggagattggctataaataccagttccaagaatgtgctaaggagcattgaaaacttccccatacgctccctatatatattcgatgctttaataaaattatctgattactttgggagtaggttctttgcaaagtctaagcttttgaaagtattggacttggaaggtacttggttggactatattcctgatgatcttggaaatatgtttcacttaaagtatttgagcttaagatataccaatgtcaagaatcttcctaaatccattggcaaactacataatctagaaaccttggacctaaagggaacactaattcacgacttaccgattgaaataaataagcttacaaagttgcgtcatcttttagtttacaacagaagagcacatttaagaattagtggtgaaagtggggtgagaataattcaaggtgttggaagcatgacagtgttgcaaaaactttatcatgtggaggtagaccatggtgggttagaactaattgcagagttaaaaaagcttaaacaattaaggaagttgggattaaagaatgtaaagagagaatatggaaatgctctttgtgagtcaatagaggaaatgaaatgccttgaatcacttcatattagtgcaataaatgaaaatgaagtcatagacttgcaatttatttcatctctacctcaacttagacaacttcacttgttcggtcgtttagaaaagcttccaaattgggttccaagacttgaacaacttgttagactgtcgattcgcttttccaagttgaaggacgatcctttaaagttactcaaagatttgccaaacttgctgcgtcttgcaattgtgtgcgatgcatatgatggagaaatgttgcacttccaagttgggtttaagaagttgaacaaactatatcttgtgcagttgaataacttgaattccattttaatagacaacggaactttacctgcccttaaactaattgaaatggtgtctattcccaaactaagtgagattccctctgattttcatctactaaagagccttgaaactctgcgtttggttaatatgccttatgagttcaaccaaagcattgatccaaatggtggaccgaagaactgggtcattgaacatgtgaaaatggtaactgttgtagagaaggttggttcaaattctgtagaattcagctatcgcactattcgtcatccaaggagtacatga

SEQ ID NO: 608 - DNA, 3531 bp, Medicago sativa
atggcttccctcacagtcacatgtcgcttcaagtacgatgtttttctcagctttagaggcgaagacacccgccacggtttcactggcaacctctggaaagctcttgatgacaaaggagtcagaactttcatggatgacgagaatcttcagaaaggggatgaaatcacaccgtcacttattaaggcaattgaagactcacaaatcgccatagttgtcctctctaagaattatgcttcatcatccttttgcttacaagaactttcaaagatccttgataccatgaaagataaggtgggtcgttttgttatgccagtattttataaggtggatccttctgatgtacgaaagttgaaagggacatatggagatgcgatggataaacttggcgaggccagctcctccagtcataataaatggaaggactctcttcatcaagttgctaatttgtctggatttccttacgagaaaagggatgggtatgtgcatgagtttattgagaagattgttgaagaagtcttaagaaatataaaacctgttgccttacctgctggtgacttccttgttggagtggagcaccaaaagcaacacgtgactttgcttttgaatgttgggtctgacgattcaatccacaaggtagggattcttgggattggtggaatagggaaaaccactcttgctctagaagtttataattcaattgtcagtcaatttgaatgttcctgttttcttgaaaaagttagagaaaattctgacaaaaatgggttgatatatctccaaaagatccttctatctcatatttttggagagaagaacacagagataacaagtgttggagaaggaatttcaatactaaaaaaaaggcttccagaaaagaaggttcttttgcttttagacgatgttgacaagaaggagcaattaaaggctattgcaggaagttccaattggtttcgtaaaggcagtagagtaataatcacaactcggtacaaaaatttgctaattagcagtggagttgaaagaatatatgaggtgaagggattgaatgatgaagatgcttttgacttggtaggatggaaaactttaaaaaacgattgtagtccacgctataaagatgttttattagaacaaaagtatggaagagaatctgatgcaaacaaattgcgtagactgaaagatttgaagaacgacgaaggctacgcaaatgtattaaaacgtgtcgtagcatatgcttctggtcatccacttgctttggaagtcatcggttctcacttttctaataagacaatagaacagtgtaatgatgcactagatcgttacaaaagagttcctcataacatgatccaaacgacactacaactgagttatgattctttgcaggaagaagagaagattgtgtttcttgacattgcatgttgcttcaaaggatggaaattgacaatggttgaaggaatacttcatgctcatcatggtcataccatgaaagaccaaattaatgtgttagtggaaaagtatctcataaaaataaatgagtctggtaatgtgacattacatgatttggtagaggatatgggaaaagaaattgttagacaagaagcacctgaagatcctggaaaacgtagtaggttatggttttccgaagatataattcaagttttagaagaaaatacaaagttccagaatatgagagttctaaaactttattatagtgacggtttaacacagatacctgatatatctggtctcccaaatttagaagaattttcaattcaaaattatgggaaattattcacaattgatgaatcggttggatctttgcgtaagcttaaaatcctgagggttataagttgcaccgaaatccacagtcttccatctctcatgttaccctctctagaagaacttgatctttcatattgtattaatcttgagagtttttcgcatgtggtagatgggtttggtgataagcttagaaccatgagtgttagaggatgcttcaagctaaagagtattccacctcttaagttggattcactagaaacaatggacctttcatgttgttttcgtctcgagagttttccacttgtggtggatgggattcttggaaaaattaaaactctgaatgttgaaagttgtcacaatctcaggagtattccaccactcaagttggattcgttagaaaaacttgacatttcatattgtggtagtcttgagagttttccacaagtggagggaaggtttcttggaaaacttaaaaccttgaatgttaaaagttgtcggattatgataagtattccaactctcatgttaagtttgctagaagagctagatctttcgtattgtcttaatctcgagaattttccacttgtagtggatgggtttcttggaaaacttaaaaccctgagtgctaaaagttgtcgcaatttaaggagtattccatctctcaagttggatttactagaaacacttgacctttcaaattgtgttagtcttgagagtcttccacttgtggtggacgggtttcttggaaaacttaaaaccctacttgttacaaactgtcacaatcttaagagtattccacctctgaagtgtgatgcactagaaacacttgacctttcatgttgttatagtcttcaaagtttttcacttgtggctgacagattatggaaactcgtgttggatgattgtaaggaacttcaggaaattaaagtgattcctccatgcttaagaatgttatctgctgtaaactgcacgtcgttgacttcttcgtgcacaagcaaattactaaatcaggaattacataaggctggaaacacttggttttgtttgccacgggtgccaaaaattccagagtggtttgaccacaaatacgaggccggattgtcaatttctttctggtttcgtaacaagtttcctgccatagctctctgtgttgtttctccattaacatgggatggttctcgacgtcattctataagagtgatcatcaatggaaatacatttatctacacagatggtttgaagatgggtacgaaatcaccgctgaatatgtatcatttgcatctttttcatatgaaaatggaaaactttaatgataatatggaaaaagtactttttgaaaatatgtggaaccatgcagaggttgattttggattaccattccagaaaagtggaattcatgtatcgaaagagaaaagtaacatgaaggatattagattcaccaatccagagcctgcaaaaagagtgctcgcctttacactcacagaaggcggtgatgatttggacaatagagtagacatgtcaaaattaaaccaagcagaggatgtagaagagagccttagtcattccttttgggaaaccaatgtagatcaaactggtttggatgcatcggataacactccttcatcattggtggaactggttaatgtgattgactatttggaaggcggtttcttctggctttgcagtgtcaagaatgcattagatttggactcggttctatcaagacttcacagcaatgtgatcaaagaagatgaatga

SEQ ID NO: 609 - DNA, 3753 bp, Medicago sativa
atggcggcggcggttgttggtgaagcttttttgtctgctttcattgaagttgtccttgacaagctttcttctcctgaggttgttgacttgatccgtgggaagaaagttgccgtcaatttgatccaaaggttgaagaacactctttatgctgttgaagctgtgcttaatgatactgaacagaaacagttcaaagactctgctgttaacaaatggcttgatgatctcaaagatgctgtttattttgctgatgatcttctcgaccacatttctaccaaagctgctactcagaagaacaagcaggtgagcaccgctgttaactacttctctagctttttcaactttgaagaacgggatatggtttgtaagttggaagatatagttgctaaacttgaatacattctcaagttcaaagatattcttggtcttcaacatattgcaactcaccaccactcttcttggagaactccatccacctctctagatgccggcgaatctaacttatttggtagggatcaagacaaaatggccatgctcaagttactgttagatgatgatcatgttgatgataagactcgtgtgagtgtgatccccatagttggcatgggtggtgtgggaaaaactactttagcccaatctgtgtacaaccatgacaatataaagcaaaaatttgatgttcaagcatgggcatgtgtttctgatcatttcaatgaactcaaggttacaaaggcaatcatggaggcaattactagaagtgcatgtcatataaataatatagagttgcttcatctagatttgaaggaaaaactggctggaaagaagttcttaattgttttggatgatgtttggaccgaggattatgacgcttggaattcacttttaagacctcttcatgatggcaccaggggaagtaaaattcttgtaacaacccgaagtaaaaaagttgcttgtatggtacaaacttttcaaggttactctcttgagcaattgtctgatgaagattgttggtcagtgtttggaaatcatgcatgcctttctccaaaagaatacactgagaatatggatcttcaaataattggcaaagagattgctagaaaatgtaagggattgcctttagcagcacaatcacttgggggcttgttgcgaagtaaacgggacatcaatgactggaataatatactaaatagtaacatttgggaaaatgagagtaatatcattccagcactccgaattagttatcattatctctctccctatttgaaacgctgctttgtttattgttccttgtatcctaaagattacacatttcgtaaagacaatttgatcttgttatggatggccgaagatcttttaaagtctcctaaaaatgggaagactttagaagaagttggtaatgaatattttaatgacttagtttcaaggtcattttttcaatgttcaggaagtgagaacaagagttttgttatgcatgacctggtgcatgatttggccacattgcttggtggagaattctattacagagtagaagaactcggaaatgaaacaaatattggtaccaagactcgacatttatcatttaccacgttcattgatccaatcttgggaaactatgatatttttggccgagcaaaacatcttcggacatttttgacaaccaattttttctgtcctccattcaacaacgaaatggcatcatgcatcattttgtcaaatttgaagtgcttgagagtcttgtcattttcccacttttcacattttgatgcattgcccgattcaataggtgaacttatccatttacgttatttggatatctcttacacagctataaagacgttaccagagtcattgtgtaatttgtacaatctacaaacgttgaagttgtgttattgttatcgtctaagcaggcttcccaatgatgtgcaaaatcttgtgaatctgcgccatcttagtttcattggaactagtttagaagagatgaccaaagaaatgagaaaattaaaaaatttgcaacatctgagttcctttgttgtgggcaagcatcaagagaaagggatcaaggaattgggagcactttcaaatcttcatggatcactatccattacgaaattagagaatattacaaacaactttgaagcctcagaggcaaagataatggataagaagtaccttgagagattattattgtcatggtctcaagatgtaaatgatcattttacagattcgcaaagtgagatggatatacttggcaagttacaacccgtcaagtacttgaaaatgcttgatataaatggatatattggcacaagatttccaaaatgggttggagatccttcttaccacaatttaactgaattatatgtgtctggttgtccaaattgttgtattcttccaccccttggactattacattctctcaaggatttgaaaatcggcaaaatgagtatgcttgagactattggatctgaatatggtgattcattttccgggacaatttttccctcccttgaaagtttgaagttttttgacatgccatgttggaaaatgtggcatcattcccataaatcagatgattcttttcctgtacttaaatctcttgagattcgtgattgtccaagattgcagggagattttccacctcatctttccgttttggaaaatgtttggattgaccgatgcaacctgcttggttcttctttcccaagggctccttgcatccgcagtttaaacatacttgaaagtaaagtatccttgcatgagctatccctttcattggaagttttaactattcaaggaagggaggcaacaaagtctgtcttggaagtcattgccatcaccccattaatttctcttaaaaaattagatatcaaggattgttggtctttgatttcgtttcccggagactttttacccttatcatccttagtgagtttgtacattgtaaattctagaaatgtagatttcccaaagcaaagccatctgcatgagtcactgacgtatcttcatatagatagttgtgattctctcagaaccctctcactggagagccttccgaacctctgtcttctccaaatcaagaactgtgaaaacattgaatgcatttccgcttcaaagtctcttcaaaatctctatcttattacaattgacaactgccccaaatttgtatcattcggaagagaaggattgtctgcgcccaacttgaaatcattgtatgtttctgactgcgttaaattgaagtcattaccttgtcatgtaaatactcttctcccaaagctaaacaatgtgcaaatgtcgaattgcccaaagattgagacgtttccagaagagggtatgccgcatagcttgagatcacttcttgttgggaattgcgagaaattattaaggaacccatctctaactttgatggacatgcttacccgacttacaattgatggtccatgtgatggtgttgattcctttccgaagaagggttttgcgttgcttcctccctccattacctcccttgctctatggtctttttcaagcctgcacacattggagtgcatggggcttctccacctcacgtccctcgagaaattaacaattgagtactgccccaagctggagactctggaaggagaaaggttgcctgcttctctaatcgaacttcaaatcgctagatgtcctctgttggaagaacggtgccgcatgaaacacccacaaatttggcccaaaatatcccatatccgaggcattaaggttgatggaaaatggatttag

SEQ ID NO: 610 - DNA, 1527 bp, Medicago sativa
atggctgttgcggttgtgggtgaatcatttctgtccgctttcattgaagttgtcctcgacaggcttgcttctcctgaggttgttgacttgatccgtgggaagaaagttgacgtcaacttggttcaaaggttgaagaacactctttatgctgttgaagctgtgttgaacgatgctgaacagaaacagctcaaagactctgctgttatcaaatggcttgatgatctcaaagatgctgtttattttactgatgatcttctcgaccacatctctaccaaagctgcaattgggaaggaaaacaaagaggtgagtgttgttaactacttctctcgctttttcaactttgaagaaagagatatggtttgtgagttggtagatatagttgctagacttgaatacattctcaaattcaaagatatttttggtcttcaacatattgcaactcaccaccactcttcttggagaactccatccacctctctagatgccggtgaatctaacttatttggtagggatcaagacaaaatggtcattctcaagttactgttagatgatgatcatgttgatgataagacttgtgtgactgtgatccccatagttggcatgggtggggtgggaaaaatcatattagcccaatttgtgtacaacaatgacaatataaagcaaaattttgatgtgcaagcatgggcttgtgtttccgaccatttcgatgaattcaaagttacaaaggcaatcatggaggcagttactagaagtgcttgtaatataaataatatagagttgcttcatctagatttgaaggaaaaactggccggaaagaagttcttaattgttttggatgacgtttggactgaggattatgatgcttggaaatcccttttaaggcctcttcagtacagtgacaaaggaagtaaaattcttgtaacaacccgtattaaaaaagttgcttctatgctacaaacttttcaaggttactctcttgagcaattgtctgatgaagattgttggtctgtgtttgaaaaccatgcatgcctttctctaaaacactccattgagaaaatggaactccaaaaaattggcaaagagattattagaaaatgtcaaggattgcctttagcagcacaatcacttgggggcttattgcgaagtaaacgtgacatcaaggattgcaataatatactaactagtaacatttgggaaactgagagattgtctgcgcccaacttgaaagtattgaacatcttcaactgcgttaacctaaaatcgttaccttgtcatgtaaatactcttctcccaaagttagacactttgctaatgtttgattgcccaaaaattgagacgtttccagaaggaggtatgccgctaagcttaagatcattttctataaggaattgcgaaaaattattgaggaacccatctctaacttcgatggagatgcttactcatcttacaattagtggtccatgtgatggtgtcgaggacttccctaacaagggttttgtgatgctgcctcttcccttacctccctag

SEQ ID NO: 611 - DNA, 3984 bp, Medicago sativa
atggctgcagtagctgttggtgaagcatttctgtcagctttcattgaagttgtccttgacaggcttgcttctcctgaggttattgacttgatacgtgggaagaaagttgacgtcaatttgatccaaaggttgaagaacactctttatgctgttgaagctgtcttgaatgatgctgaacagaaacagttcaaagactctgctgttaacaaatggctcgatgatctcaaagatgctgtctatgttgctgatgacattttggatcacatctctactaaagctgctgctacttcttggaagaacaaggagaagcaggtgagtactcttaactacttctctcgctttttcaactttgaagaaagagatatgttttgtaagttggaaaatatcgccgctagacttgaatccattctcaaattcaaagatattcttggtcttcaacatattgctagtgaccaccactcttcttggagaaccccatcaacctctcttgatgctggcgaatctagcatatttggaagagataaagacaaagaagccatactcaagttactcttagatgatgatcatgttgatgataagacttgtgtgagtgtgatccccatagttggcatgggtggggtgggaaaaaccactttagcccaatctgtgtacaaccatgacaatataaagcaaaagtttgatgttcaagcatgggcttgtgtttctgaccatttcgatgaattcaaggttacaaaggcaatcatggaggcagttactagaagtgcttgtaatataaataatatagagttgcttcatctagatttgaaggaaaaactgtccggaaagaagttcttaattgttttagatgatttctggaccgaggattatgatgcttggaattctcttttaaggcctcttcaatatggtaccaagggaagtaaaattcttgtaacaacccatattaaaaaagttgcttctatggtacaaacttttcaaggttactctcttgagcaattgtctgaagaagattgttggtccgtgtttgcaaaccatgcctgtcttcctccagaagaatcctttgagaaaatggatctccaaaaaattggcaaagagattgttagaaaatgtcagggattgcctttagcagcacaatcacttgggggcttgttgcgaagtaaacgtaacctcaaggactgggatgatatactaaatagtaacatttgggaaaatgagagtaagatcattccagcactccgaatcagttatcattatctccttccttatttgaaacgttgctttgtttattgttccttatatcctaaggattatgaatttcataaagacaatttgatcttgttatggatggccgaaggtcttttacagcctaaaagaagtgggatgactttagaagaagttggtaatgaatattttaatgacttagcttcaaggtcattttttcaatgttctggaaatgagaacaaaagttttgtgatgcatgatctagtgcacgatttagccacgttgctcggtggggaattctattacagaacagaagaacttggaaatgaaacaaagattagtaccaagactcgtcatttatcatttagcacattcactgatccaatctcggaaaactttgatatttttggccgagcaaaacatcttcggacgtttttgacaatcaattttgaccatcctccattcaaaaatgaaaaggcaccatgcaccattttgtcaaatttgaagtgcttgagagttttgtcattttcacactttccatatcttgatgcattgcctgattcaataggtgaactgatccatttatgttattttttggatatctctaaaacaactataaagacgttaccaaagtcattgtgtaatctgtacaatctacaaacgttgaagttgtgttattgtaattatctaaaaaggcttcccaatggcatgcaaaatcttgtaaatttgcgccatcttagtttcattggtactaggttagaagagatgactggagaaatgagcaaattaaaaaatttgcaatatttgagttgctttgttgtgggcaagcctgaagagaaagggatcaaggaattgggagcactttcaaatcttcatggatcactttcaattgagaagttagagaatgtgaccaacaactttgaagcatcagaggcaaagataatggacaagcaccttgagaaattactattgtcatggtctctagatgcaatgaataattttacagattcgcaaagtgagatggatatactgtgcaagttacagcctgccaagtacctggaaaagctaggtatagatggatacaggggcacgcgatttccagaatgggttggagatccttcttaccacaatttgaccaagttatctctgtctcattgtcagaattgttgtatccttccaccacttggacaattacgttctctgaagaagttggtaatttatcgaatgagtatgctgaagattattggatctgaatttttcaagattggtgattcgttttcagagacaccttttccctcccttgaatgtctggtgtttagtaacatgccatgttgggaaatgtggcagcatcccgaagattcatatgattctttccctggagattttccatctcatcttcccgttttggaaaaaattaggattgatggatgcaacttgcttggttcttctctcccaagggctcatgccatccgtgatttatacataattgaaagcaataaagtagtcttgcatgagctacccctttcattgaaagtgttatccatcgaaggaagagatgtgacaaagtccttctttgaagtcattgtcatcaccccatcaatatctattaaaaatttggagattgaggattgttcctctgcagttttgtttcccagagattttttacccttatccttagagaggttgtccatcataaattttagaaatctagatttctcaatgcaaagccatctgcatgagtcatttaagtatcttcgtatagataggtgtgattctctcgcaaccctcccactggaggcccttccaaacctctactctctcgaaatcaataactgtaaaagcattgaatatgtttccgcttcaaagatccttcaaaatctctttcatattataattagagattgccccaaatttgtatcattctcaagagaaggattgtctgcgcccaacttgaaacaattgcacatcttcaattgctttaacttaaagtcattaccttgtcatgtaaatactcttctcccaaagttaaacgatgtgcaaatgtatgattgcccaaatactgagatgtttccagaagggggtatgccgcgtagtttgagatcactttgtgttggaaattgtgagaaattattgaggaatccatctctaacttcgatggacatgcttacccgacttaaaatttatggaccatgtgatggtgtcgagtccttcccgagcaagggttttgtgttgctgcctccctcccttacctccctggatctatggactttttcaagcctgcacacattggagtgcatggggcttctccacctcaagtccctccaacaattaacagttgaagactgtcccatgctggagactatggaaggagaaaggctgcctccttctctaataaaacttgaaattgttgaatgtcctttgttggaagaaagaacaacaattactgctgaagatttgttagctactatgcaaaaattgggctttgatgactatgctcggtattccttccgctacatccaactttttcgtcatggtgctcgtgtaggtcaatatgctcccccacctccacctccaccaccgccgccacaggattttcaagctcataattttccattggatccgaatttcatgtttgccgacccaacagaaatgggtgcaattttaggagatggtgatgatgaaagagaacttggtggtggtggtggtgatggcaactcaagtgatggaagctttgatgtttttgcttttcttaatagtgatgactga

SEQ ID NO: 612 - DNA, 2826 bp, Medicago sativa
atggcagaggtagcagtatcaacagtagtaacaaaactaaccgaacttctcttagaacaaacaacctcaacaatctcacacatatccacagttcgcgaccaagtcgaatctctcaaaaaccaactatcatggatgcaatgtttcctcaaagatgctgacgctaaacaacaatccaacgaacgtgttcgtatgtgggtttccgatattcgtaacgtcactttcgaagctgaagaaatcattgaaactcatatctataattccactattcaaacccattttcataacaaaatcttcactccttttcatctctataaacttggttcccgaattgaaagaatttgtaaaaaaatcaaagaggtttctgatagacgtgaaatgtatggtgttgttatcaaaaaccctggctctaactctaaccctgacgaccgtgatggtagcagttctaacgagagattgagacattggagacaaccttccccttattatgctgaagaagagtatgttgttgaggtaaaagaagattttggttcaatttttacacagttggttagtttggattctacgagacatgttgtttcgcttgttggtatgggtggtttaggaaaaactactttggcaaagaaattgtataatgatagtagaattgcgaatcattttgagattaaagcttgggtttatgtttctgaggagtataggaggaaggatgttttgcaagggattttgagaggtgttgatggtgttgcgagggaggatatggataggatgccggaggaggagttggtgaataagcttcacaatgctttggcggagaaaaggtatttggttgtgcttgatgatatttgggggatggaggtttgggatgggcttaaatatgcttttccgaggaggaaattagggagtaagattttgctgacgacgaggattttggaggttgctttacatgctgatgggaatagtgatccttatcagttaaggccgttgaatcatgatgagagttatgcattacttaggagtaaagcgtttcctggtgcgagtgtgataccatccgagtttgagaatcttgccaaggagattgtagtgaaatgtgaaggtttgcctcttgctgttgttgtggttggtggtttgttgtctagaaagttgaagtctagtggggaatgggctagggagttgcagaatattagagggggtttgcttgaagatcaagagaagataacaagaattttagcattgagctataatgatttgcctccgccgttgaaatcgtgttttctgtatttgggtcttttcccaaagggtatgaacattcagacaaaaaaattgattagactatgggttgctgaaggttttttgcctcaagaaggtggtgaaactgcagaagatgttgctcagaggtacttgaatgagttgattggtaggtgtatgattcaagttggaacggtgagttcgatggggagagttaagacgattcgaatccacgatcttcttagagagctttcggtcaccaaaggaaaagaggagtattttggtgatatggcaggctcatcatcaacatctcagctaactaaatcccggcggcattctctacattcttgccatgaacggtatgatttcttaaaacatattgcagattattcgcgttcgttgttgttcttcaatagagaatataatgcagatatagacaagaaagtctggattcatttgagttttatgcaagaaaagaaattgaatttcatctacaccgaatttaagctactcagggtgttagaattagacggtgttcggttagttagcttgccaagtactataggggacctgattcaattaaggtatttgggattgaggaagactaatctcgaagggaaacttccgctttccattagaaacttgcttaacctacaaacacttgatttaaggtattgttgttttcttaagaaaataccaaatgtaatttggaagttggtgaacttaagacatttgctcctgtatacaccatttgattctcccgatagcgggcatctacggttggatacattaaccaaccttcaaagcctaccatatattgaggctggaaactggatatcagatggtggtttagcaaatatgaccaatcttaggcaattggggataaatgggttatcaggacaaatggtgaattctgttctttctactatacaaggattacgcaaccttcattcactgtcactatcacttcaatctgaagaggatgaatttccaatctttatgcagctttctcagtgcacacaactgcagaagttatctttgaatggaaagatcaagaagctacctgatccacatgagttcccgccgaatctgttgaaactaactttacataattcccacctacagaaggagtctattgccaaacttgagagattgccaaaacttaaaatgcttgttttgggtaaaaaggcatacaattgggcagaattgagcttcagtgctgaagggttttcacaattgcatgttttgcggctcactcttttgaaagaattggaggaatggaaagttgaggaaaaggcaatgccaatgctcgagtacatggttattgaccggtgcgagaagctgagaaagattccagaagggctgaaggatatcacttctttgaagaaactaaaaattacaggcatgccggtagattttgaacatagacttcgaactaaagatttgcttgagttcaaaaatattccaattatcgaatcaacaacagacattttatcgattgtaaggagagtagatcagatgaacgatagtcagatcaaaagaggtagaggaagacctagaaaaactataaagagaaactactag

SEQ ID NO: 613 - DNA, 731 bp, Medicago sativa
acaaaatgtgtgacactgcactttcctgcgctcgtgataacttgcttccactagcccgtgatcatttgcttccaatcttgaaggaagcattcaacatgattaagggtgtcccaaaagaaattgcagaattgaaagatgaactagaaagaattgaaaaattcatcaacaatgcagatagaatggctgatgctgaagaagacgtggaaacaagtcagaaaatcaaagcaatgatcaaacagttgatagaagcatcttttcatatagaagatgtcattgatgattatatcttccttgaagaacatcaatcttctgatcttggatgtgctgctggtcttgacttgatcaaaactaagattcttcgtctccaaatagcagttaagattcagaacatcaattctcgaattagagaaataaaacaagattcaagtgaaaaagatcatggcttccaaatccgatcttcttccgataagccatcaagtagttctccaacaagtgaaaacgcctcattattgcacaaccttcaagacgcttccatttatatggatgaagctgatattgttggctttgaagagccaagagacaaattgattgatttgttggtagagggaagagaagaccgcacagttgtctccattgttggaatgggaggattgggaaaaccactctagccagacaaatttttgacaaccaaaaggtagttaagcactttgactgtcttttatggatcatgg

SEQ ID NO: 614 - DNA, 3505 bp, Medicago sativa
atggatattttaatttctgttgttgcaaaaatagcagaatataccgttgtgcctattggacgtcaagcaagttacttgatattctacaaaggcaacttcaagaagttaaaggatcatgttgaagaccttcaggctgcaagagaaataatgctccattcggttgcaagagaaaggggaaatggtagagaaattgaaaaacatgttctaaattggttggagaaagtgaacgaggtcattgaaaatgcaaatcggcttcaaaacgatcctcgtcgtcccaatgttaggtgctcagcatggtcattccccaacttgattttacgtcatcaactaagtaggaaagctacaaaaattacaaacgatgttgatcaagttcaaagaaaggaggtttttgatcaaattggctaccttccccctcttgatgtagtagcctcctcctcctcaacaagagatggtgaaaagtatgacacaagggagttgcttaaggaggacattgtgaaggctttagcagatcctacttcacgcaacattggggtctatgggttgggtggggtggggaagaccactctggtgcggaaagttgctgagacagccaatgaacataaattgtttgataaagtggttatcacagaagtatcgaaaaatccagacattaaaaaaattcaagcggagattgcagatttcttgggtctgcgatttgaagaggagagtattctcggcagagcagaacgccttagacaaagaatcaagatggagagaagtgtccttatcattctagataacatatggaccatacttgatttgaaagaagtggggataccagttggtaatgaacataatggttgcaaattgttgatgacaagtagaaatcaagatgtgttgctgcaaatggatgtcccaaaggatttctctttcaaagttgaacttatgagtgaaaatgagtcatggagcttgtttcaatttatggcaggggatgtggttaaagatagcaatttgaaagatctaccatttaaagtggccagaaaatgtgcaggtttgcctcttagggtagtgacagtagcgcgtgcaatgaaaaataagagggatgttcagtcttggaaagatgcattaaggaaattacaaagtaatgatcatacagagatggacccgggaacttattctgctttggaattgagttacaactcattggagagtgatgatatgagggatctcttcttgctttttgcattaatgctaggtgatgatatagagtactttctcaaagttgcaaaggggttggacatattgaagcatgttaatgccatagatgatgcaagaaacagactttacacaataatcaaatctttggaggcggcttgtcttttgcttgaagttaaaacagacggaaatatccaaatgcatgactttgttcgtgattttgctatctccatagcacgtagggacaagcatatatttctaagaaaacaatctgatgaggaatggccaaccaatgattttctaaaaaggtgcacgcagatctttctaaaaagatgtcatacactcgagcttcctcaaacgatagattgtccaaacgttaagcttttctatttgggctgtaacatttcttctttcaaaatccctgatgctttttttgagggaatgagaagccttagagtgctagacttaacgcgcttgaacttgttatcattacccacgtcgtttcggttcctaacagagcttcaaacattgtgtttggattattgcattttggaaaatatggatgcaatagaagctttgcaaaatttagaaattcttcgcctttggaaatcttcaatgatcaagttgccaagagaaatagggagattgattcgattgagaatgcttgacttgagccattcaggaatagaggtagtcccacccaacatcatatcaagcttgactaaattggaggagttgtacatgggtaatacctctattaattgggaagatgtgagttcaacgtttcataatgaaaatgctagtcttgccgagcttcaaaaactacccaaattgacagctctagaattacaaattcgtgagacttggatgttgccaagggacttgcaattggtgtttgagaagctggaaagatataaaatagctattggagatgtatgggactggtctgacatcaaggatggaaccttaaacacattgatgctcaaacttggtacaaacatacatttggagcatggaattaaagcattgattaaaggtgttgagaatttgtatttggatgatgtagatggaattcaaaatgtgcttcctcacctaaatagagaaggatttacattgctgaaacatctccatgtccaaaataatactaacttgaatcacattgttgacaataaagagagaaatcaaatccatgcgtcctttcccatcttggaaacactagtgcttcttaatcttagaaacttggagcatatatgtcatggtcaaccttcagttgcttcttttggaagtctcagtgttatcaaagtaaaaaattgcgtccagttaaagtatcttttctcctttacaatggttaaaggactttctcacctttctaagattgaagtttgtgagtgcaattctatgaaggagatagtgttcagagacaacgattcaagtgctaataatgatatcactgatgaaaaaatcgagtttcttcaattgcgttctttgactttagaacatttgaagacacttgataattttgcctctgattatttgacacatcatagaagtaaggaaaagtatcacgatgtagagccatatgcttctactacaccatttttcaatgctcaggtttcatttcctaatttagataccctgcacgtgggctcacttctcaatttgaacaaagtctgggatgacaatcatcaatcaatgtgcaacttgactagcttgattgtggataattgtgttggattgaagtatttattcccctctactttggttgaaagttttatgaacctcaaacaccttgaaataagtaactgtcctatcatggaggagataatagctaaagaagacagaaacaatgcagtgaaagaggttcgttttttgaatttagagaaaatcgtattgaaggatatggacagcttgaagacaatatggcatcgccaatttgaaacatccaagatgttggaagtgaacaattgtaagaaaattgtggtggtttttccttcttcaatgcaaaacacatataatgagcttgagaagttggaggttacaaattgtgcttttgttgaagagatatttgaattgactttcaatgaaaataacagtgaagaggttacgacacatttgaaagaggtcactatagatggattgtggaatctggaaaagatatggagtggagatccggaaggaattcttagttttcaaaatctaataaatgttcaagtagtaaattgtgctagcttggagtatttattaccattctccgtagccactcgttgctcacatctcaagaaacttggtataaaatggtgtgaaaacatta

SEQ ID NO: 615 - DNA, 3149 bp, Medicago sativa
ggcacgaggaatcaacttagcatattcagatggctagcagcagcaactcctcttcttcagctcttatggcattgccaaggaggaagaattattatgatgtgtttgtcacctttagaggcgaagatactcgcttcaacttcattgatcatctttttgctgcccttcaaagaaaaggcatttttgcatttagagacgacgctaatcttcaaaaaggtgaatccataccacccgagctcattcgtgcaattgaagggtctcaggttttcattgcggtcctctccaaaaactattcttcctcaacttggtgcttgcgagaattggtacacatccttgactgcagtcaagtttctggaagacgtgttcttcctgttttttatgatgttgatccttctgaggtgagacatcaaaaaggaatttacggtgaagccttttccaaacatgaacaaacattccaacatgactctcatgtggtacaaagttggagggaagctctgacacaagtggggaatatctctggctgggatcttcgtgataagcctcaatatgctgagattaaaaagattgttgaagagatattgaatatattgggtcacaacttttcatctcttccaaaagaactagttggtatgaatcctcatatagaaaaagtagtaaatctattacttttggactcggttgatgatgttcgggttgtaggaatttgtgggatgggtggaatagggaagacaactctgactactgctttatatggtcaaatctctcatcaatttgatgcacgttgttttattgatgatctaagcaaaatatatagacatgatggtcaagttggtgcacaaaagcaaattctacaccaaacttttggcaaggaacactttcagatatgcaatctctttgacacggatgatttgatacgacgtaggttacgtcggctacgagcacttatcattctcgataatgttgataaagttgaacagctcgataagttagctttaaatcgtgaatatttaggtgcagggagtagaatcattataatttctagagatgagcatatcttgaatgagtatggagttgatgaagtttacaaagttccactcttgaatgagaccaactctcttcaattattttgtcaaaaagctttcaaacttgagcatgttatgagtggttatgataaaatggcacttgacacactatcttatgccaatggcctaccactagctattaaagtattgggctcatttttgtttggtcgagatatctccgaatggagaagtgcattggctagattgaaagaaagtccaaacaaagatattatggatgtgttgcgattaagttttgatggattggagaatttggaaaaagaaatatttcttgatattgcttgttttttcgaaaggtacgataaggaatgtcttacaaatattctaaattgttgtggatttcatccagatatcggattaagaattcttattgataaatcccttataagcttttatcacggaggttgtgtaatgcatagtttgttggtagagttggggaggaagattgttcaagaaaattcgaccaaagacttgaaaaagtggagcaggttgtggttccccgaacatttcgacaatgtaatgttggagaatatggaaaagaacgtccaagccatagttttggcctaccacagtccaagacaaataaaaaaattcgcagcggaaacattgtcaaatatgaatcatattaggttacttatactcgagaatacgtacttttcaggaagcctcaattacctttcaaatgaattgagatatgttgaatggaacagatatcctttcacgtatttgcctaagagttttcagcccaaccaacttgttgaacttcatttgagctatagcagcatcaaacaactatggaaaggcaagaagtatctacccaatttgagaattatggatctgatgcactccagaaacctaatcaagctgccagattttggagaggttccaaatcttgagatgctgaatctggcaggatgtgtaaatctgataagcatacccaacagcatatttgttctcacctctcttaaatatctaaatctttctgggtgttccaaagtgtttaactatccaaagcatttgaagaaacttgattcgagtgaaactgtactacattcccaatcaaaaacttcctccttgatattgaccacgattggtttacattccttgtatcagaatgcacacaaaggtttagttagtcgtttgttgtcatccttgcctagctttttctttttgcgggaacttgatattagtttttgcggtctaagccaaatcccagatgctattggatgtatacgatggttaggaagattagttttatcgggaaacaattttgtgactctgcctagtctcagggagctttctaaacttgtatatttagacttgcagtactgcaagcagttaaattttttgcctgagctccctttgcctcactcttcaactgttggtcaaaattgtgtggtgggattgtatatttttaactgtcctgaattgggggagaggggtcattgtagtagaatgactttatcatggttgatacaatttcttcatgccaaccaagaatcctttgcttgctttcttgagactgatattggtattgttattcctggaagtgaaataccaaggtggttgaacaatcagagcctaggtaattcaatgagcataaacctatcttccattgtgcatgacaaagattttattggccttgtagcctgtgtagtattttctgtgaaacttgattatccaaatattacaacaaatgaacttgaaaataatatatgcataagtcttgatgaagatcatactcgtactggttatggattcaattttagttgtccggtaatttgttatgcggatctttttacaccggaatcagaccacacatggctattatatctcccttgggatcgcctgaatccagacaaaacattcaggggttttgatcatatcacaatgacaactttcattgatgaaagagaaggtttgcatggggaggtgaagaaatgtgggtatcgttgcatatttaaacaggatcaacaacagtttaactcaacaatgatgcaccacagaaattcatcttcacaaaagcgcaagtttttggcaattgaagattag

SEQ ID NO: 616 - DNA, 4464 bp, Medicago sativa
atggagtttcttactgaactatcaaaagaagctgtctcaaaacttggagaattggcagtgcagtctacagtgaagcagtttgaatatgtgatccagcacaaacaaattattgccgacttgaaggaagaacacaataagttgaagggtgtcaaagaagctctacaagcatgggttgacacaaaaagaatgaatagagaaggaactgaacctaacatagaaaagtggctcaatgacgttgcagcatttgaaaatgtgttacaaagtttctacgaagaaaaagttaagatgaacaagaaatgttttggtggaaagtgtccaaatttgacatataattactcattgggaaagcaagcctctaaaagcattgaatatattataaggttgaaggaggaaaaaaatgaattccagctcatatcctaccataaagctccaccaactcttggatccaccttcactgaagatattaagagcttggagtctaggaagataatcataaaaggagtcatagagaaactgaaggatgataagttcaaaagaataagcatatgtggaatgggtggagtgggaaaaaccactctggtaaaagaaatcatcaaatctgtagaaaataagttatttgataaagttgtgatggcagtgatatcccaaaatcctgattacaagtatatccaaagtcaaattgctgattgtttaggcttgagtttgaaaagtgaaagtgtggatggaagaggcagggaattaattcataggttgaaggaaatcgatgatgatggaaagattaaagtcctagttgtgctcgatgatgtgtggagtgagcttaattttgattgggtgggacttccatctcgagataatcaaaaatgtagcaaaataatattcacatcacgaaatgaaaaggaatgtcaaaagatgggaagccaagtgaattttcatgtttctattttgcttaaggatgaagcctggtatctgtttcaatcaatggcaggtgatgttgtatatgaacctcgtatttatccaatagcaaaacaagttgcaaaggaatgtggaggcttgcctcttgctattgtaattgttggaaaagcacttgaaaatgagaaaaagcttagtgcatgggaggatgcatttgaacaattacaaaattcacaatcatcttccttctcagatgttcacaattttgtttactcacgcatcgaacttagtttcaaattttggggtagcacagaacacaagaaattccttatgctttgtggattgtttccggaagactttgacatacctattgaaagtttattatgtcacgcaatgggcttgggattgttcaaagctatcggtgagccatggaaagcaagaaaccgagtgaatagttttgtggacgatctaaagagatgcttcttgttgttggatagcaatgtcccagggtgtgtgaagatacatgatattgtacgtgatgttgtcatattagttgcatttaaaatagaacatgggtttatggtgagatatgacatgaagagtttgaaagaagagaaattaaatgacatcagtgcattatcacttatcttgaatgagacggtagggttagaagacaacttagagtgtcctacccttcagcttctacaagttagatcaaaagaaaagaaaccaaaccattggccggaacatttcttccaatgcatgaaatcactcaaagttttgtctatgcaaaatgtgtacattccaaaacttccatctctatctcaagtctcagttagcctccatatgctgctattagaatattgtgatgttggagatatatctataattggtaaggaacttatacacctagaagtcttaagttttgcacactctaaaattaaagaacttccagttgaaataggaaacttgagcattctaagattattggatttgacaaattgcaatgatcttaaagtcatttctactaatgtcttgataagattgtctcgattggaagaactttatttaaggatggacaattttccttgggaaaaaaatgaaattgcgatcaatgagttgaaaaagatatctcatcagctaaaggttgttgagatgaaagtcagagggactgaaatttcagtcaaggacttgaacttatacaacctacaaaagttttggatttatgtggatctttatagtgattttcagcgctctgcatatttggagtcaaatttattgcaagtcggtgctatagattatcaatctattaatagcatattgatggtctcacaattgattaagaaatgtgaaatccttgcaataagaaaggtgaaaagcttgaaaaatgttatgccacaaatgtcacctgattgtccaattccatacttgaaagatttaagggttgattcatgtcctgatctccaacatctgatagattgtagtgttcgttgcaatgactttccacaaatccattcattgtctttgaaaaaacttcagaatttgaaagagatgtgttatacacataataaccatgaggtcaagggaatgataattgacttctcatattttgtgaaattggaattaatagacctcccaaacttgtttggctttaacaatgctatggatttgaaagagctcaatcaagtaaaaagaattagttgtgataaatctgaactaacaagggtcgaggaaggtgtgctatcaatgagtggcaagttgttttcatctgattggatgcaacatttcccaaaattggaaacaatcttgctacaaaattgttcttccattaatgtggtctttgacactgaaagatatttagatggccaagtatttccacaattgaaagaactggagatatctcaccttaatcaactaacacatgtctggagtaaagctatgcattgtgttcaaggttttcaaaatttgaaaactttgacaatatcaaattgtgactctctgagacaagtatttactccagctattattggagcaatcaccaatattgaggaattggagatacaatcttgtaagttgatggagtatttagtgacagatgatgaagatggtgatgaaggtgaccatattaataaagaggaagtaaatattatctcgtttgaaaaattagattccttaacactttcaagactcccaagtatagcacatgtttctgcaaattcttacaagatagaatttccatccttaagaaagttggtaattgatgattgtccaaagctagatacattgcttttgctatgtgcatatacaaagcacacaaatcattccactgcatcatatttaaatcttgatggcactggtgttagccattttgaagaaaacaacccaagatcttctaattttcattctggttgtacgccgctgtgttctaaattgattcgacaaagcaaaaaaaataacaaaatcaacaaggctccttctgtttctgaaacaaaactcgagatagagttgggtggtgcacctcttcttgaagatctttatgtaaactattgtggtttgcaagggatggataaaacaaggataagaagcgcgccagttatagacggacacttgttcccatacttaaaatcactaatcatggagagctgtaacaaaataagtgtcttgttatctttttcgtctatgagatatcttgagcgtctagagaagctacacgtattgaattgcagaaacttaaatgagatagtatctcaagaagaatcagaatcaagtgaagaaaagattgtgttcccagcattgcaagatctgcttcttgaaaaccttccaaaccttaaggctttcttcaaaggaccctgtaatcttgattttccatcactacaaaaagtggacatcacagattgccctaatatggaattgttttcacgaggactttgtagtgcacagaatcttgaggatatcaacatatgtcagaatgaattatgcatcaccagctacataaataagaatgacatgaatgccactatacaaagatctaaagcatgtgtggaattgaaaagttctgagatgttgaactggaaggagctaattgataaagacatgtttggatacttttccaaagaaggggcaatatacatcagagaatttcgtagattatcaatgcttgtaccattcagtgagatacaaatgcttcaacatgtaaggatactcggtgtaggtgactgtgattcattggttgaggtgtttgaatcagaaggagaatttacaaaaaggggtgtcgctacacattatcatctacaaaagatgacactggaatatttgccaagattgagtcgcatatggaaacacaatatcacagagtttgtaagctttcagaatctaacagaaattgaagtttctgattgccgcaatttgaggagtttgctctcccattctatggctagaagccttgtgcaacttcaaaaaatagtagttgttagatgtggaatcatggaggagataataacaatagaaggggaatctatagaaggaggcaacaaagtcaagactttatttccttag

SEQ ID NO: 617 - DNA, 3390 bp, Medicago sativa
atgttgggatcaagttcttctgctgctgcggctatttctcctcctagtcaaactcagaagtatgatgtgttcctcagctatagaggggaggacacacgtgacaacttcatcactcatctatatgctgaattgattcatctatatgatgaatcaatgatttatgtcgttgttttgtctgagaactatgcttcttccacatggtgtttgaaatttacaagcaacggcagttgggagttgggaccaaaccgccgccatgcaagaatctggggtatgggaggaatagggaaaacaacaattgctagtgcaatatatcgcaaattggcaacccaattcagttttaacagcatcatcctaaatgttcaacaagaaatagagagatttggactgcaccatatacaaagcaaatatagatttgagcttctgggagaaaacaacacatcctctggattatgtctttcatttgatcaaaggctcaaatggactaaggctctccttgttcttgatgatgttaacaattcggatcaacttagagatttaattggaaagcttagtaagtttgcaccaggtagtagaatcattgtgactagcagagacatgcaggtactgaagaatgtcaaagctgatggaatatatgaagtcaaggagatgaattttcatgaatctctacgactcttctgtttaaatgcctttaaacaaagttatcccttagaaggttacgtggggttatcagagaatatattaaattatgccaaaagggttccattagcactcaaagttttgggttttttactttgcggtagaccaaaggaagcatgggaaagtcagttacaaaagctggataagcttcctgagaatgacattttcgaagtgctgaaattgagttatgtagaacttgatgaagaacagaatgagatatttcttgatatagcttgtttctatagaggacatttggagaatgttgttttacaaacactggatagttgtggtttctcttccctaattggaatagaggttctcaaagatagaggccttatatctattgtggaaagtaggattgttatgcatgatctaatacaggaaatggggcatgaaattgtccatcaacaatgtgtcaatgatcctggaaaacgcagtcgactatggaagcatagagaaatttataaagttttaagaaacaacaaggggacggacgcaatcaggtgtatattgttggacatatgcaagatagaaaaggttcaactacatgctgaaacattcaaaaagatggacaatcttagaatgatgttattctataagccttatggcgtttcaaaagagtcaaatgtgatccttcctgcatttctagaaagtcttccagatgatttaaagtttcttcgttgggacggattccctcaaaagtctttgccagaggattttttccccgacaatcttgttaaactttatatgccccatagccatcttaaacaactatggcagagagataaggaaaatcaatcatttaattattttattccatggtttaccaaatctgaaaacactttacctttgtggttctcagaacctgattcagataccagacctggtcaatgcccaaatattgaagaagtaattcttagtcactgcacaaagttgagtaaagtctactcttctagttttctgtccaagctcaagtgtttatggttaaattggtgtattagcctcaagagtgtacacattcctagcaatattctccagacaacttccgggttaacagtactccatggttgttccagtcttgacatgtttgtagtaggtaatgaaaaaatgagggttcaacgtgctacaccatatgacatcaacatgtccagaaataagcgtctcaggattgtagcaacagcacaaaaccaatcaataccgcctcttgagtcaaatacttttgaacccctagattttgttgtgttaaataaagaaccaaaagataatatacaattactgagcctagaagtgttgagagaagggtcaccctcattattcccaagtcttaacgagctttgttggttagatctctctcactgtgattctctcttgagccttccaactgaaatcttcaaattaaaatttctaaaaagactttacctccttggttacttaaatttggagaagatccctgaaattaaggagactcatttggttggacttgaagaattgagcttgtgttactgtcgagagctcgagactattccatcttccattggaagtcttagcaaactcagcaagttagaccttacctactgtgagtcacttgaaacttttcctagcagcattttcaaattgaagttgaaaaagcttgatttgcatggttgctcaatgctgaaaaacttcccagatatcttggagcctgcagaaacttttgttcacattaacctaacaaaaacagcaattaaggaactgccttcatctttggagtataatttggttgcacttcaaaccttgtgcctgaagttatgcagtgatctggtgtcacttccaaacagtgttgtaaatctaaactatctatctgagattgattgttctggctgttgtagtttaacagaaatcccaaataacattggtagtttgtcctcattgaggaaactttcacttcaagaaagcaatgttgtgaaccttcctgagagcatagctaacctctcaaatttaaaatcacttgatttaagtttttgcaaaaggcttgaatgcatcccacaacttccatcctctctaaatcaattgttggcgtatgattgcccgtctgttggaagaatgatgccaaattcaaggttggaattatcggcaatttccgataacgatatcttcatattccatttcaccaatagtcaagaactggatgaaactgtttgcagtaatatcggggctgaagcatttcttaggatcaccaggggtgcatataggtctctgttcttctgttttcctgggagtgcagttcctggtcggttcccttatcgttgtacaggaagtttggtaaccatggaaaaagattctgtagattgtcccaataattacaggctttttggttttgctctgtgtgtggttttgggacgtgtggatatggtaattgataacatcatttgcaaattaacatttgaatctgatggtcacacacacagtcttcctatttctaactttggcaataattactattgctatgggaagggtcgagacatgttattcatccaagatcacacattcatatggacatatccattgcactttcgaagcattgacaacagagtctttgatgcccagaaatttacttttgagttcagtgaagtctgtgaagacaattgtctctcatatcttaaatcggatgtcatggtgaaagagtctggagtatgccctttttatacaatatga

SEQ ID NO: 618 - DNA, 5887 bp, Medicago sativa
atggatttttgtatggagctgccaaaaggagctgcctcaaaacttggagaaatgggagtggagtctatcataaagcaatttaaatatatgatccaatacaaaaatataattgccaatttgaatgaagagcacaataatttggattctttgagacaatcattgcaagggtgggtggatgcagaaagcacaaaaggaaacgaaattccacgtaacgtgttgaactggctctctaaagaagcagaaattgaagctgtgttagaaagtttctatgaaaacaaagttaacaagaacaagaagtgcttttggggccagtgtataaattttgcattcaattactcactgggtaagcaagcaactgaaaaaatagaagttgttacaagattgaacgaggaaggaaaacagctttcacttatatcctaccgtaaggatgcaccagcacttggatcaaccttcatagaaaattacaagagtttggagtccagaaaccaaattatacaagtgctcatagagaagttgaaggatggtcaactcaaaaggattggcatttgtgggatgggtggagtggggaaaaccacacttgtgaaagaactcatcaaaactgtagaaaataagttatttgataaagttgtgatggctgttgtatcccaaaatcctgattacgagaagattcaaagacaaattgctgatggtttaggtttggagttaaaagggcagagtttggaaggaaggggttgggaaatatttcaaaggtttaaagaatttgaagagaagaatgttaaggtgctaatagtcttagatgatgtgtggaaagaacttaattttgagttgataggactttcttctcaagaccatcagaaatgtataaaaatattattcacatcacgagatgaaaaggtgtgccaacagaatagaagccaagataatgtacatgtctctgtgttgctccacgatgaagcttggagcctatttcgagaaatggctggaaatgttgcaagcaaacctgatatcaatccaatagcaagtgaggttgcaagggaatgtggtggtttgccccttgcaattgcaacagttggacgagcacttggcaacgaggaaaaaagtatgtgggaggttgccctacaacagctgagacaagctcaatcatcatccttctcaaacatgcaggaatgtgtatattcacgaattgaacttagcatcaatatattgggtgttgaacacaagtcatgccttttcctttgtggattgtttccagaggactttgacattcctatagaaagcctgttgcgtcacggggtgggcttggggttgtttatggtagatgattatgtttggaaagcaagaaattatataaactatttggtgaatagtctgaaaaaatgtttcctattgttagacagtgaagaaccagggtgtgtaaagatgcatgatgttgtgcgtgatgttgtcctaaaaatttcatccagagaagaacttgggattttggtgcagtttaatgtagaattaaagagggtgaaaaagaaactagcaaaatggcgtaggatgtcccttattttggacgaggatattgagttagaaaatggcctagaatgtccaactctagagcttttacaggttctatgtcaaagagaaaatagagaagtgaatatatggccagagaactttacccatggaatgactaaactcaaagttttatatattcaaaatgtgtgcattccaaaaacattatctcatttccatgcctcagtcaaccttcgcacgctgcagctagaaggatgtgatgttggagatatatctataattggtaaagagttaaataaactagaaatcctgagctttgccaattctaatattgaagaacttccacttgaaattgggaatttggagtttctcacattattggatttgacaggatgtgattatcttaattctatttctcctaatgtcttagcaaggttatcaagtctggaagagttttattttaggataaaaaactttccttggttgctaaacagagaagttctcaatgagttaagaaatatttctccacagttgaaggttcttgagatcagagtaaggaagatggaaattttaccatgtgatatggatttcaaaaacctggaatttttttgggtttatattgtttctaatgattcttatgagcgctgtggatatttggagccaaatagaatacaattaagagatttagattacaactctatcaagagtagtgtgatgatcatgcaactgttcaagaaatgtgaaattctcatattagaagaagtgaaggacttgaaaaatgtcatatctgaattggatgattgtggactccaatgtgtgagagatttaacccttgtttcatgcccccatcttgagtgtgtcatagattgcaatactccattctctgcattcccattgatcaggtcgttgtgtttatcgaaacttgccgagatgagagaaattattcatgcacctgatgaccaagaaaccacaaaagcaattatcaaattctcaaatttggagaaattggagctgatgttcctcgacaagttgattggctttatgaacttcagttttttgaacgagcatcatcaactaattcatagtggattgagttctacaactaaattaacagattcaacaaacatcgaggatggtgaaacctccagatcaaatccagatggttgtagaccctcatcagttagtggcaagttgttttcatctaattggatcatacactttccaaagttggaaataatggagttactagaatgtaattccatagagatggtatttgacttggaaggatattcagaattgatcggaaatgcacaagattttctgtttcctcagctaagaaacgttgagataatacagatgcatagtttgttatatgtgtggggtaatgttccatatcatattcaaggctttcataatttgagagttctaacgatcgaagcatgtggttctttaaaatatgtatttacttctgtcattgttagagcaatcacaaatcttgaggaattgagagtaagctcttgtaaaatgattgagaacataatagtttacagcagagatggtaaagaggatgatactattaaaggagatgtggccgcaactattaggtttaataaactatgttatttatctctttctggacttccaaagcttgtgaatatttgttcagattctgttgagttagaatatccatccttgagggaatttaagattgatgattgtccaatgttgaagatatctctatcaccaacatatatccatgcaaatcaagacagcctcaacaatgtcacacattcaaaaaataaagaagatgataatattgaagtaaacaactcaaactcgtcaacttgcccccctgcagggtgtactccttttctgtccaaattctttcataaaggaaacgcaaataagagaattaacaaggaagtatcaataacacgagcaccagaggatcatataccttctagttttgaaatgaagatgaagaaaggaaaaagtcatatgcctgttctagaagacttgtgcataggaaaatgtgattttctagagtttatattttttcacaaagaaaaagtcaatttcttagttccttcacacttgaaaaccatcaaaattgaaaagtgtgagaagttaaagaccatagttgctagcacagaaaatagaaaggacgtgacaaactcgtttactcagttagtgtcaccttcacttgaaagatcttccacatcttgtgaagtttagcatttgtggaccatatgagtcatggaacaaccaaatagacaaggatgaatgtatggatgatcaagaaagtattagatgtcatctactcatggatgattccttgtttccaaacttaacttctttgctcatagaagcttgcaacaaaattagcatcttaatctctcattcatctttggggagtcttgagcatcttgaaaagctagaagtacgaaattgcaagaacatgcaagaaatagcatctctagaagaaagttcaaataagattgtgttacataggttgaaacatctaattcttcaggagctacccaaccttaaagccttttgcctaagttcatgtgatgtctttttcccgtcattgcaaaaaatggaaattaatgattgtcccaatatggaagttttttcactaggattttgtactacacctgtgcttgtggatgtcacaatgaggcaatcatcactcaatattagaggctatatacagaagacagacatcaatgatattgtacgaggatttaaagcatttgtggcatcacaaggatcgaagatgttgagctggaccatgttgcataatgaaggatactttatcaaaaactcaaaaataagtatcaaagaatgtcatgaactgccatatcttgttccttacaataaaatacaaatgcttcaacatgtggaggaactcactgcaggttattgtgattcactagttgaggtgattgaatcaggaggaggaaaaggtacaagaaaaggggatgtcaacacacattatcaattaaaaaatttgacattgcagcagttgccaaaattgattcacatatggaaacatgatattgtggaggttataagcttccagaagcttacaaaaattgatgtttatgcttgccacaatttgaagagtttgttctcccactctatgggtagaagccttgtgcaacttcaagaaatatcagtttgggattgtgaaatgatggaggagataataacaaaggaagaggaatatatagaaggaggcaataaagtcaggacattatttcctaagttggaggtattgtcacttgcatatcttcctaagctgaaatgtgtttgttcaggagattatgactatgatatccctttatgcactgttgaagtggaaaaggaattcaataataatgataaggttctgattttatttccacaattaaaggatttagtgcttagtaaagtaccagagctcaagtgtttttgttcaggagtgtacgactacgatatcatggtgtcgtcaactaatgagtgtccaaatatgagaacctttccccatggaaatgttattgtagacacacccaaccttgatcatctatggttggagtggatatatgtgcaaacacttggagacctaaatttgacaatatattatcttcataattcagagaaatacaaggcggagttgcaaaaattagagacatttagagatatggatgaagagcttcttggctacatcaaaagagtaatagtgcttgagattgtaaactgtcataagctattgaattgcatcccatccaacatgatgcaattattctcacatgtgaagtctctaacagtgaaagaatgtgagtgcttagtagagatatttgaatcaaatgatagcatcttgcagtgtgaactagaggtcttaaatttgtattgtcttccaaaactgaagcacatctggaaaaatcatggtcaaactttaaggttcgggtatttacaagagataaggatcaagaagtgcaatgatttggaatatgtgattccggatgtttccgtggtcacaagccttccaagtttgatgtcgattcatgtgtctgaatgcgagaagatgaaggagatcattgggaataattgtttacaacagaaagctaagattaaattcccaaagctgatgaaaattaaactaaagaagcttcctagcctcaaatgtttcagtgaaagctctttccattgctacgttgagatgccagcatgtgagtggatactaattaatgactgtccagagatgaagaccttttggtacaatggaatcttgtacactccagatatgacgacggacgcttcacatgcttcttcagaagtggtttctagttcaaatctagatgaagctctttggttcctagactaa

SEQ ID NO: 619 - DNA, 3225 bp, Medicago sativa
atggtgagtgatcagagcagaaaatcatcatatgacgtgtttatcagcttcagaggagcagacacacgattcaacttcactgatcatcttttttccgccctccaaataagaggcattgttgcatttagagatgacactaagcttaagaaaggtgaatctatagcacctgaactccttcgtgctatcgaagcctctcggactttcattgttgtcttctcaaacaactatgcttcctcaacttggtgcttgcgggaattgcaatacatccttcattgcgtacaactttctggaaaacgtgttctccctgttttctatgatgttgatccttccgaggtgcgaaagcaaagtgggagttataaaaaagcatttgcccaacatgaggaaagattcaaacaagacactgaggtcctgcaaggatggaggacagctctcacgcaagtcgccaatctttcaggttgggatatacgtgataagccccagtcagcagagattaaaaagattgttgaagagatagtaaatatattgaattgcaaattttcaagccttccaaatgatttagttgggacgcattctctcatagaaagattggaaaagcttttacttttggatgtggttgatgatgttaggattgttggaatttctgggatgggtggagtagggaagacaactcttgctaggattttatatagaagaatctcttctcggtttgatgcatgttgctttattgatgatctaagcaaaatttgcaaacatgctggtccagttgctgcacaaaagcaaattctaagccaaactttaggcgaagaacaccttcagatatgcaatctaagtgacggagctaatttgatacaaaataggcttggtcatctgagggccttcataattcttgataatgttgatcaaggagaacaattggagaaattggctttgaaccgtaagctgttaggtgttgggagtagaatcattataatttcgagagatactcatatcttgaataggtatggagtggatgtagttttcaaagttccactcttgaatcaaactaattctcttcaattattttgccaacaagctttcaaacgtgataatattttgagtaattatgacgagttggtatatgagatactaaattatgctaatggcttaccactagcgattaaagcattgggctcatttttgtttggtcgagatatttatgaatggagaagtgcattgactagattgagagacaatccaaacaaagatatcttcgatgtattgcgattgagttttgatgggctagagaacatggaaaaagaaatatttctcgatattgcatgttttttcaatggacgtaaggaagcacttgttaaaaatgtactgaattgttgtggatttcatgctgatattggattaagagttctcattgacaaatcacttataagcatatcagaaaaaagtaagattgaaatgcatggtttgttagaagagctgggcaaaaaaattgttcaagaaaattcaagcaaagattcaagaaagtggacaaggttgtggctccatgaatatttcaacaatgttatgtcagagaataaggaaaagaatgttgaagccatagttttgaggcgtggacggcaaagagaaacaaaaatagttatagccgaagcattgtcaaagatgagtcatcttagaatgcttatacttgatggaatggacttctcaggaagcttggattgtatttctaatgaattaagatatgttgagtggcgggaatatcctttcatgtatttgccatcaagttttcaaccctaccaacttgttgagttgatcttggaagatagcagcatcaaacaactatgggaaggcacgaagtacttgccaaatttgagaactcttgaattgaggaactccaaaagtctaataaaagtgccagatttcggagagatccctaatcttgagcggctaaatctcaaaggatgtgtaaaacttgagcagatagatccatctattagtgttctaagaaaacttgtttacttgaatttggaagattgcaaaaatctagtaaccataccgaatgacttgtttggtctcacctctcttgagtatctaaatctttctggatgttacaaggcatttaacacttcattgcatttgaagaattatattgattcaagtgaaagtgcgtcacattcccaatcaaaattttccatatttgactggatcactttgcctctccaatctatgtttccaaaagaaaacctggacatgggtttagcaatacctagttgtttgttgccttcattgccaagcttatcctgtttgcgtaaacttgatattagttattgcagtttaagccaaatccctgatgctattggttgcctactttggttagaaagattaaatttagggggaaacaattttgtgacattgcctagtttcagagaactttcaaaacttgcatatttgaatttagagaactgtatgcagttgaaatattttcctgagcttccttcagcttcctccatcgaacacgagcacagtcatatgttttcagatactagttattggaggagagcaggattgtgtattttcaactgtcctgaattgggtgagatggaaaagtgcagtgacttggcattttcatggatgatacaatttttgcaggcaaaccaattagaatcctcctctgtcttcttccgcgaaatcaatattgttatacctggaacagaaatgccaaggtggttcaacaatcagaacatggaaagttcaataagtatagacatatctcctatcatgcatcatgacagtgatgtcattgcttttgcgtgttgtgtagtattttctgcagcgccttatccatctacgaatatgaaaaccaattaccgaaagcctgtaatacatttgtgttttagtagcggtgacttggaggtatttctaggcattccagcacatacaaatttaaatatgctgaaatcaaatcacatttggctagcttatttcactcgagaatcattcattgatcttatgagtgatatagacagtacacttggtgatattagaatggaagttttgattgtggatggtgaaggtttggatgtagaggtgaagaattgtggttatcgttgggtatataaacatgatctacaacatctcaactttacaatgatgcattgcaaaagttcattagctcagaactgcgacattttgggaatcgaagatgaggcacaaccagaagtgaaaccacggtaa

SEQ ID NO: 620 - DNA, 1941 bp, Medicago sativa
atggattgtcttactgaattgggaaaggaagctgtcacaaaattgggagaattggttgtggagtcaatcatgaagcatttcaaatatttgacacaacacaaaaaaatcacaacaaatttggaggaagaacttgagaggttgaaaatgataaaacaagcattgcaaacaagggttgaaactgaaagaaggaaaggatatgaaattgcacctaatatgcaaaaatgggtctatgatgtgacaacaattgaagatcagttgcaaaagtggctctctgatgaaaatagaggagaagattataaagaggtcatagagaaactcaaggatgatcaagtcaatatgattagcatttgtgggatgggcggagtgggaaaaaccacaatgtgcaatggcagtgaggttttgggcatggaattgaaaaaggtcagcgagaaaggaagagccatgcaattacatgagagactgatgagaaaagataaaaaggttctaattgtccttgatgatgtgtgggatattctagactttgagtgggaagttgtagatagaaatgatatcaatccaatagcaaaagaggttgcaaaggaatgtggcggcttaccgcttgcaattgcgacaattggaagagcactgagcaatgaagggaagtctgcatgggaagatgcactaagacaattaaacgacgttcaatcatcttcctccttgggtgttggaaaacatatctacccccggattgagcttagtttaaacaagaaaccgagtgcatacattggtggaagatctaagacgaaagttcttgttgttggacagcaatgtgctgtgaagatgcacgatattgtgcgcaatgttgttatatctatagcatttaaaaatgcagaagataaatttatggtacaatacacctttaagagtctaaaagaagataaattgagcgagatcaacgcaatatcacttattttggatgatacaaaagtgttagaaaatggcttacactgtccgacgcttaaacttttacaagtaagtacaaaaggcaagaaaccattgtcttggcctgaacttttcttccaaggcatgagtgcacttaaagttttatccttacaaaatttgtgcattccaaaactgccatatttatcccaagcttcactcaatctccacacgttgcaagtggaacattgtgatgttggagatatatctataattggtaaggaacttaaacacctagaagtcctaagttttgcagattctaatattaaagagctcccatttgaaataggaaatctgggcagtctaagattattggatttgtcaaattgcaacgatcttgtcatcatttctgataatgtcttgataagattgtctcggttggaagaaatttactttagaatggacaattttccttggaagaaaaatgaagcttcactgaacgagttgaaaaagatatctcatcagctaaaggttgttgagatgaaagttggaggggctgaaattttagtcaaggatttggttttcaacaacttgcaaaatggggtgtccgacattcgaactccaacatgtattcacttttctgtcattgcaagagaaatcacaaatcttgagaaactggaagttaaatcttgtgcgttgattgagaatataattgaatggagtagagatgaagaagatgaaaataaagggcatgtggcaactattagcttcaataaacttgattgtgtatcactttcaagccttccaaagcttgtgagtatttgttcagattcactttggttagaatgtccatccttgaagcaatttgatattgaggattgtcctatcttggagatgtatttcttaccaaccaatattgatgcaaagcatgacaacctcaataacgtaaaagatgttggttttcaaagtttccaagaaaacaactcaaggtcttcaagttggtcctctagaaatgatacctaa

SEQ ID NO: 621 - DNA, 2952 bp, Medicago sativa
atggctagcagcagcaactcctcttcttcagctcttatggcattgccaaggaggaagaattattatgatgtgtttgtcacctttagaggcgaagatactcgcttcaacttcattgatcatctttttgctgcccttcaaagaaaaggcatttttgcatttagagacgacactaatcttcaaaaaggtgaatccataccacccgagctcattcgtgcaattgaagggtctcaggttttcattgcggtcctctccaaaaactatgcttcctcaacttggtgcttgcgagaattggtacacatccttgactgcagtcaagtttctggaagacgtgttcttcctgttttttatgatgttgatccttctgaggtgagacatcaaaaaggaatttacggtgaagccttttccaaacatgaacaaacattccaacatgaatctcatgtggtacaaagttggagggaagctctgacacaagtggggaatatctctggctgggatcttcgtgataagcctcaatatgctgagattaaaaagattgttgaagagatattgaatatattgggtcacaacttttcatctcttccaaaagaactagttggtatgaatcctcatatagaaaaagtagtaaatctattacttttggactcggttgatgatgttcgggttgtaggaatttgtgggatgggtggaatagggaagacaactctgactactgctttatatggtcaaatctctcatcaatttgatgcacgttgttttattgatgatctaagcaaaatatatagacatgatggtcaagttggtgcacaaaagcaaattctacaccaaacttttggcaaggaacactttcagatatgcaatctctttgacacggatgatttgatacgacgtaggttacgtcggctacgagcacttatcattctcgataatgttgataaagttgaacagctcgataagttagctttaaatcgtgaatatttaggtgcagggagtagaatcattataatttctagagatgagcatatcttgaatgagtatggagttgatgaagtttacaaagttccactcttgaatgagaccaactctcttcaattattttgtcaaaaagctttcaaacttgagcatgttatgagtggttatgataaaatggcacttgacacactatcttatgccaatggcctaccactagctattaaagtattgggctcatttttgtttggtcgagatatctctgaatggagaagtaaattggctagattgagagaatgtccaatcaaagatattatggatgtgttgcgattaagttttgaagggctagagaatatggaaaaagatatatttcttgatattgcttgttttttcaaagggtacaacaaggaatgtgttacaaatattctaaattgtcgtgggtttcatgctgatatcggattaagaattctcattgataaatcccttataagcatttcttacggaactaatattacaatgcatagtttgttggtagagttgggccggaaaattgttcaagaaaattcgaccaaagacttgagaaagtggagcaggttgtggtccctcgaacatttcaacaatgtaatgttggagaatatgcccaaccagcttgttgaactttatttgtggcgtagcagcatccaacaactatgggaaggcaagaagtatctgcccaatttgaaaactatggatctgatgtactccaaacacctaatcaagatgccaaattttggagaggttccaaatcttgagcggctgaatctcgacggatgtgtaaatcttgtgcaaatagatccatctattggtcttctgagaaagcttcactgcaagcaattgaaatttttgcctgagctccctttgcctcactcttcaccttctgttatcaagtgggatgaatattggaagaagtggggattgtatattttcaactgtcctgaattgggggagaaggatcaatatagtagcatgactttattatggttgatacaatttgttcaggctaaccaagaatctcttgcctgctttcgtgggactattggtatcgttattcctggaagtgaaataccaagctggttgaacaaccagtgcgtaggtaaatcaacacgcatagacttatctcctactttgcatgacagtaatttcattggccttgcttgttgtgtcgtattttctgtgacatttgatgatccaactatgacaacaaaggaattcggaccagacatatcgctagtttttgattgtcatactgctacacttgaatttatgtgtccgaacaaagcattcaaagatgttgatcatatcacaatgacagcttgccttgaggacggaaacgggttgcatgtggatgtgaaaacatgtgggtatcgttatgtattcaaacaggatctaaaacagtttaactcaacagtgatgcaccacagaaatccgtttgcacagaagcgcaacgatttcatttcagctgcacttccaatcaactttgaaattacaacaaggtttgcattaggtggtactggtcaacaatggttggaatcaataggcaatcggatcctcaatttggaatcagtctgcaattgtccgaaattccatttgtcggcaacagttagacctgcacaaagtccaacagcaattctttatcctacaagtggaagaaacatcaattatcttcaagccataacaccttgtgcagtctttgacattttatctccacaccatagtcttcagaggatggaagagctgactccacttccggcaatcacaaagaaaagaacttccagctctaatgagatcgacaagaggaggaactactatgacgtgtttgtgagcttcaaaggtaaagacactcgctacaacttcattgatcatctttttgcttccttccgaagaaaaggtatcattgcattcaaggacgatgcaatgctcaagaaaggtgaatccattgcaccatag

SEQ ID NO: 622 - DNA, 3385 bp, Medicago sativa
tatcatccaaagaagcaccagttcctctcttcttcggctatgatgatcaagtatgacgtttttgtgagctttagaggccaagacacacacaacaattttgccgatcatctttttgctgcccttcaaagaaaaggcatcgttgcattcagggatgattctaacctgaagaaaggtgaatccatagcacccgagctccttcatgcaattgaagcctcaaaggtttttattgtactcttctcaaaaaactatgcttcctcaacatggtgcttgcgagagttggaatacatccttcactgcagtcaagtttctggaactcgtgttctccctattttctatgatgttgatccttctgaggtgagacatcaaaatggaagttatggagaagcccttgccaaacacgaggaaagattccaacatgaatcagagatggtacaaagatggagggcaagtctaacacaagtcgccaatctctctggttgggatatgcatcataagtaagaaattttctacggattgatgattgaaaagattgttgaagagataacgaatatatcgggtcacaaattttcatgtcttccaaaagaattagttggaataaattatcctatagaaaaagtagcaaatctattacttttggactccgttgatgatgttcgggttgtaggaatttgtgggatgggtggaatagggaagacaactcttactactgctttatgtggtagaatctctcatcgatttgatgtacgttgttttattgatgatctaagcagaatatatagacatgatggtccaattggtgcacaaaagcaaatcctacaccaaactcttggcggggaacactttcaaatatacaatctatatgacacaactaatttgatacaaagtaggctacgccgcctacgagcacttataatagttgataatgttgataaagttgaacaacttgataaattagctgtgaatcgtgaatgcttaggtgcagggagtagaatcgttataatttctagagatgaacatatcttgaaagagtatggagttgatgtagtttacagagttccactcttgaatgggaccaactctcttcaattattttctctaaaagctttcaaactttatcatattatcagtgattatgaggagtttgacatatgacatattaaattatgctaatggcttaccactagccgattacagtgttgggatcatttttgtttggtcgagacatctatgaatggaaaagtgcattggctagattgagcaaaagtccaaacaaagatatcatggatgtgatgcgattaagttttgaagggttagaaaaattggaaaaagaaatatttcttgacattgcttgttttttcattcagagcaagaagatttatgtccaaaaagttctaaattgctgtggattccatgctgatattggattaagagttctaattgataaatcacttctaagcatttcagaggaaaataatattgaaatgcatagtttgttaaaagaattgggcagagaaattgtccaagaaaagtcaatcaaagattcaagaaggtggagtagggtgtggctccatgaacaactccacaatattatgttagagaatgtggtaaactgtagaaatgaaggttgaagccatatattttccctgtgatatagacgaaaacgaaacagaaatattaatcatgggtgaagcattgtccaaaatgagtcatcttagattgctcatactcaaggaagtgaagttcgcagggaacctcggctgcctttctaacgagttaagatacgtagagtggggtagatatcctttcaagtatttgccagcatgttttcagcccaatcaacttgttgaattgatcatgaggcatagcagcgtcaaacaactatggaaagacaagaagtatttgcccaatttgaaaattttggatctaagccactcaaagaatctaagaaaggtgccagattttggagagatgccaaatctagaagagctaaatctcaaaggctgtataaagcttgtgcagattgatccatcaattggggttctaagaaagcttgttttcatgaaattgaaagattgcaaaaatctagtaagcataccgaacaacatacttggtctcagctctcttaaatatctaaatctttccgggtgttccaaagtgtttaacaatccaaggcatttgaagaaatttgattcgagtgatattttatttcattcccaatcaacaacttcctccttgaaatggaccacaattggtttgcattccttgtatcatgaagttttaactagttgtttgctaccttcttttcttagcatatactgtttgagtgaagttgatatcagtttctgtggtctaagctatctccctgatgcaattggatgtctacttcgactagaaagattaaatataggggggaacaattttgtgacactgcctagcctgagggagctttccaaacttgtatatttaaacttggagcattgcaagcttttggaatctttgcctcaacttccttttcatgcacacaaagatatagctagtcgttttctgcattccttgcttagcttatcttgtttgaatgatcttgatattagtttttgtggtataagccaactaccgaatgcaattggacgtttacgttggctagaaagattaaatctagggggaaacaattttgtgacggtacctagccttaggaagctatccagacttgcatatttaaacttgcagcattgtaagttgttgaaatcgttgcctcaacttccttttgctactgctatcgagcatgatcttcatattaacaatcttgataagaacaaatcttggaagtcaaaaggacttgtcattttcaactgtcctaaattgggtgagagggaatgttggaatagcatgatattttcatggatgatacaactcattcgggcgaacccacaatcctcatctgatgtgattcaaattgttactccgggaagtgaaataccaagttggttcaacaatcagagcaatagtcgttcattatcaatagccctatctcccgttatgcatgatgacactgacaataatttcactcctagtgtactactaccttcttactatctttgttttgtcaactgtttttctctgttctctattttgacactcagttcttttcaattgctcagcatggggagttatgaaaatatatcatacacattgtcttcaactatttctgcaataggatcggacgatcctacgacccagcactcgtttttggctaccttgatcttaagttctaaaagtttcaagttggtcaaaaatgttactcaaattggagtaagttaaccctttctatcacttggcatttagagatctggttgagaatacaggcgttggaatttcttatttacag

SEQ ID NO: 623 - DNA, 627 bp, Medicago sativa
atggatcctattgcggataaaattgttgaagttgtggttccaccctttactcgtcaaattagttacgtattcaactacaacgacaactttaaaaaaatgatactcgggctccaaaaccttgatggaaaaagagctagtgtgcaacacacagttgatgaggctataaggaacggagaaaaaattgaaaatcttgtccacaattggctgaacaaagctgccaacaccgttgctgatgcaaacaaacttcttgacaccgaagaccatgcgaaggttcagtgttctatgggacactgtcccaatccgatcaaaaggcaccggttgagcaggaacatggcaaagatgattcaagatatttccgaagtcatagcagaaggagaatttgaacgaatttcttaccgtggtgcttctaaaatcacaattacgccattcagtagaggttatgaggctctagattctagaacatcaatgttgcatgaaattatgatggatttgaagaatcctaacatatccattattggtgtttgtgggatggggggagtaggcaagacaacactaaattgtggcacttcaagaggaatgcaactttggagcttcagcatagtttctatcttctccttgattttctag

SEQ ID NO: 624 - DNA, 3159 bp, Medicago sativa
ctgattacgccaagctcgaaattaaccctcactaaagggaacaaaagctggagctccaccgcggtggcggccgctctagaactagtggatcccccgggctgcaggaattcggcacgagggtcctgctctcctctctctctctctctgcttctccgctatcaaatcttctctctagcattaacaagatcatccaaatccgctcctcttcttcagctctgatggcatcgccgtggaggaagaattattatgacgtgtttgtcaccttcagaggcgaagatactcgcttcaacttcactgatcatctttttgctgcccttcaaagaaaaggcatttttgcgtttagagacgacgctaagcttcaaaaaggtgaatccataccacccgagctcattcgtgcaattgaagggtctcaggttttcattgcggtcctctccaaaaactatgcttcctcaacttggtgcttgcgagaattggtacacatccttcactgcagtcaagtttctggaagacgtgttcttcctgttttttatgatgttgatccttctgaggtgagacatcgaaaaggaatttacggtgaagccttttccaaacatgaacaaacattccaacatgactctcatgtggtacaaagttggagggaagctctgacacaagtggggaatatctctggctgggatcttcgtgataaaactttcaggcctcaatatgctgagattaaaaagattgttgacgagatattgaatatattgggtcacaattattcatctcttccaaaagaactagttggtatgaattctcatatagataaagtagcaaatctattacttttggactccattgatgatgttcgggttgtaggaatttgtgggatgggtggaatagggaagacaactctggctactgctttatatggtcaaatctctcatcaatttgatgcacgttgttttattgatgatctaagcaaaatatatagacatgatggtcaagttggtgcacaaaagcaaatcctacaccagactcttggcgtggaaccctttcagctttgcaatctatatcacacaactgatttgatgcgaaggaggctacgtcgcctacgagtacttataattgttgataatgttgataaagttggacaacttgataaattgggtgtgaatcgtgaatggttaggtgcagggagtagaatcattataatttctggagatgaacatatcttgaaagagtatggagttgatgtagtttacagagttccactcttgaattggaccaactctcttcaattattttctctaaaagctttcaaactttatcatattatcagtgattatgaggagttgacatatgacatattaaattatgctaatggcttaccactagcgattacagtgttgggttctagtttgttcagtcgaagtatctctgaatggagatctgaattgactaaattgaaagtaagtccacataaagatattatggatgtgctgcagttgagtttaattgggctaatggagatggaaaaagaaatatttcttcatattgcatgtttcttcaacgggcgagaggaggactatgttaaaaatgttctgaactattgtggatttcatgctgatataggattaagagttcttgttgataactcactcatacacatttcagatgaaagtaagattgaaatgcatggtttgttcgaagtgctaggcaaaaatattgttcatgaaatttcaagaaagtggagcaggttgtggctgcatgaacaattctacaatgtcgtgtcaaataatatgggcctaaattatctttctaataaattaagatatcttgaatgggaagccgaaaagggaatattgatggctgaagcattgtcaaaaatgaacagtcttgaattgctcattctcaaaaaagtgaaagtttcgggaagcctaaattatctttctaataaattaagatatcttgaatgggatgaatatcctttcttgtatttaccatcaagttctcagcttgatgaactttccgaattgatcttagtaggtagcagcatcacacaactatggaaagacaagaagtatctgcccaatttgaggaatctggatctaagctgctctaaaaatctagccacgatgccacattttgcagagttcccaaatcttaagcggctaaatcttgaaggatgtgtaagccttgtgcagattaattcatctattggccttctaagagagcttgttttcttgaatttgaagaattgtaaaaatcttatatgcatacccaatgaaatatctggtctcacctctcttaaatattttactatttgcggctgttccaacacgtttaaaaactccaaagcacatggatatttttctagctgtttgttgccttccttgcctagcgtgtcttgtttaagtgaaattgatatcagtttttgcaacctaagtcaaattgtttccttgaatttaaaagattgcaagaatcttgtaagcatacccaacaacatatttggtctcagctttcttaaagatctaaatatgtgtgggtgttccgaagtgtttaacattccatgggatttgaatataattgaaagtttgagaaatttggatctaagccactccaaaaatttaataaagatgccacattttggagagttcccgaaccttgagcggctagatctggaaggatgtataaaacttgtgcagatagatccatctattggtcttctaacaaagcttgtttacttgaacttgaaagactgcaaacatataataagcctactcagccttgatattagcttttgcggtctatgtctaatccccgacgcaattggatctatattggttagaatatttaaacttagggggaaataattttgtgacagtacctagcctgagggagctttccaaacttgtatatttaaacttggagcattgcaaactgttggaatctttgcctgttcttccttctcctactgctatcgagcacgatctttataaaaacagtcttcctgcgtatgaaactaggtggcgtacaagattgcttattttcaactgtcctaaattggatgagagggaatgctacattagaatgacattttcatggatgatacaattcattaaggcaaaaatgactaatattcaatttaaatttctcattccatctgcaatctgaagg

SEQ ID NO: 625 - DNA, 5634 bp, Medicago sativa
atggattgccttactgaattgggaaaagaagctgtcacaaaattgggacaattggttgtggagttatccatgaagcattttaaatatttgacacaacacaaaaaaattacaatcaatctggaggaggagctcaagaacttaaaaatgatgaaacaagcattgcaaacaaaggtggacaatgaaagaaggaagggacatgaaattgaacccatcgtgcaaaaatggctatctgatgtgacaattattgaaaatgagtggcaaaaatggatctctaatgaaaataatgttaacaagaagaagaaatgttttggtggacaatgttcagatatagcatttaattactcattgggaaagcaagcaactaaaaggatagaatatattacaagcctgaaggaggaaaaaaacaaatttaaagatatatcttaccctaaagcttcattaacacttggatctaccttcacaaaagatgtcaagagcctattgtctagagaaaaaattataacagaggtcatagagaagctcaaggatgatcaagtcaaaatgattagcatttgtgggatgggcggagtaggaaaaaccacactggtgaaagaagtcatcaaaacaatagaaaaaaacaatctatttgatgaagttgtgatggcagtggtttctcaagatgtaaattatgagaagatccaaattcaaattgctgatactttgggcatggaatttaaaaaggacagcttgctaggaagagcaatggaactacttgagagactgagtaaaggtaaaagagtcttaatagttctagacgatgtgtgggatattcttgattttgagcgtattggacttcaagaacgtgataaatattgcaaaatattgttcacatcacgggatcaaaaagtgtgccaaaatatgggatgcagagtgaattttcaagtccctgtattgtcggaggatgaagcttggagcctatttcaagaaatggcaggagatgttgtaaacaaacatgatatcaatccaatagcaagagaggttgcaaaggcatgtggtggcttgccccttgcaattgtgacagttggaagagcactaagcattgaagggaagtctgcatgggaagacacacttaaacaattaagaaattttcaatcatcttcctcgtcagatgttgaaaaatttgtccaccctcgcattgagcttagtttaaagtttttgggaaacaaagaatacaagctattccttatgctttgtggattgtttcctgaagactttgatattcctattgaatgtttgttgcatcatgcagtgggtttgggaatgttcaaacacattactgcatcatgggaagcaagagaccaagtgcatacattggtagataatctaaagagaaagtttttgttgctggaaagtaatgtgcgaggatgtgtaaagatgcatgatattgtgcgaaatgttgttatatcatttttatttaaaagtgaagaacataaatttatggtgcaatacaactttaagagtttaaaagaagagaaattgaatgacatcaaagcaatatcacttatcttggatgattcaaacaagttagaaagtggcttagagtgtccgacacttaaactttttcaagtaaggtcaaaaagcaaggaaccaatctcttggcccgaacttttcttccaaggaatgtgtgctcttaaagttttatctatgcaaaatttgtgcattcctaaactctcgtctctatcccaagccccattcaatctccacacattgaaagtagaacattgtgatgttggagatatatctataattggtaagaaacttttacttctagaagtcctaagtttgtcacattccaatgttaaagaactcccaattgaaataggagatttgggcagtctaagattattggatttgacaggttgcaatgatctgaatttcatttctgataatgtcttgattagactgtttcggttggaagaactttactttaggatgtacaattttccttggaataaaaatgaagttgcgatcaacgagctgaaaaagatatctcatcagctaaaggttgttgagatgaaatttagaggtactgaaattttactcaaggatttggtcttcaacaacttacagaagttttgggtttatgtggatcgatactctaattttcaaagatcttcatatttggagtcaaatttattgcaagttagttctataggttatcaatatataaatagcatattgatgatctcacaagtgattaagaaatgtgaaatccttgcaataaaaaaagtgaaagacttgaaaaatattataagccacttattaagtgattactcaattccatacttgaaagatttaagggttgtctcatgccctaatttggagtatctcatagattgcactgttcattgcaatggcttcccacaaattcagtcattgtctttaaaaaaacttgagaatttcaaacagatatgctactcctctgatcaccatgaagtcaaaagattgatgaatgagttctcatatttggtgaaaatggaattaacaggtctcccaagctttattggctttgacaatgcaattgaatttaatgagctcaatgaagaatttagtgttggcaaattgtttccatctgattggatgaaaaagtttccaaagttggaaacaatattattaaaaaattgcatttccttaaatgtggtgtttgatttgaatggagacttgaattctagtgggcaagcattagattttctgtttcctcaactaacaaaaattgagatatccaacctaaaaaatctatcatacgtgtggggcattgttccaaaccctgtccaaggctttcaaaatttgagattcctgacaatctcaaattgcaaatctttaacacatgtatttacttctgttattgtaagagcagtcacaaatcttgagagattggaagtaagttcttgtaagttgattgagaatatagtgacctcaaatagatgtgaagaagagtatgacaataaaggacatgtgaaaactattggtttcaataaactttgttatttatcactttcaagacttccaaagcttgtgagtatttgttcagaattactttggttagaatatccatccttgaagcaatttgatgttgtgcattgtcctatgttggagatctctttcttaccaacacatattggtgctaaacgagacaacctcgatgtcacgtattctgcaaactcaaaagatgttagttttcacagtttaaaagaaaacaattcaaggtcttctaatcggtctgttagctgtattccatttatacccaaatttattcaacaaggaaccacaagtaagagaaatagtaaggaagcattggtcacacgagctacaagagaaaagggggaagacatgatacactcttttcctttactagaatctcttcacttaatatatctgccaaatcttgtgagactttgctcttttggaacatacgaatcttgggataaacaacaattcatgaatggtggatttgtggaagatcatgtaagctcaagatgtcacccactcatagatgatgccttgtttccaaacttaacttctttgctcatagaaacatgtaacaaagtcaacatattgttctctcattcaatcatgtgtagtcttgagcatcttcaaaagctcgaagtacgacaatgtgaaaacatggaggaaataatatctaatcaagaagaaatagatgcaactaataataaaattatgctccctgcattgcaacatctacttcttaaaaagttacccagccttaaggcctttttccaaggtcaccataatcttgattttccatcattggaaaaagtggatattgaagattgtcccaatatggaattgttttcaagaggtgattcttatacacctaatcttgaggatctcaccataaagattgaatcactcagcagcaattatatgcagaaggaagacataaactccgtaatacgggggttcaaatcatttgtagcgtcacaaggattcgtgatgttgaactggaccaaactacataatgaaggatatttgattaagaactctaaaacaaacatcaaagcatttcataaattgtcggtgcttgtgccgtacaatgagatacaaatgcttcaaaatgtgaaggaactgaccgtaagtaattgtgattcactaaatgaggtgtttggatcaggaggaggagcagatgcaaaaaagatagatcacatttccaccacacactatcagctgcaaaatatgaaattggataatttacccaaactgagttgcatatggaaacacaatattatggcggttgcaagcttccagaagataacaaatattgatgttttacattgccataatttgaagagtttgctttcccattcaatggcaagaagccttgttcaacttaaaaaactaacagttggttattgtgacatgatggaagagataattacaaaggacgaccggaatagtgaaggacgaaacaaagtcaagattttatttcctaaattggaggaattgatccttggtccccttcctaacttggaatgtgtttgttcgggagattatgactatgatgtcccaatgtgcgatgtagtagaggacaaagaaatcaataataataagattcagatttcatttccagaattaaagaagttaatattttatcatgtgccaaagctcaagtgtttttgtttgggagcgtacgactacaatatcatgacgtcgtcaactgaagagtgtccaaatatggcaacatttccctatggaaatgttattgtaagggcacccaaccttcatattgttatgtgggactggagtaagattgtgcgtactcttgaagaccttaatttgacaatatattattttcaaaattcaaagaaatacaaggcagagatccaaaaattagagacatttagagatatcaatgaagagcttgttgcctacatcagaagagtaacaaagatcgacattaaaaagtgtcacaagctgttgagttgcatcccagcgaacaagatgcacttattctcacatatgcagattctcaatgtgcgagaatgtgggggcttagaagagatatttgaatcaaatgatagaagtatgaaatatgatgaattattgtctatatacttgttttctctgcctaaactgaagcacatttggaaaaatcatgttcagatattaagatttcaggaattgatggaaatatacattgaaaagtgtgatgaactgagctgtgtgttctgggatgtttccatgaccacgagccttccaaatttactatacctttcagtgtgtgattgcggaaaaatgcaggagataatcgggaatagtagtaattcaaatcctattaattgtgtaatagaacagcaacagagggctaagatcatattcccaaaattgtttgaaattagactacagaagcttcccaaccttaaatgtttctctcagagctctttcccttcctatgttgaactgccaagctgttatttaatcataattgaagactgccatgagatgaagactttttggttcaatggaaccttgtacacaccaaatctttggtctttatttgtggagaataccaaatttgacatagatgaagatgtgaacgaggcgatactacaacacaacaaatgctttgaacgttga

SEQ ID NO: 626 - DNA, 1080 bp, Medicago sativa
atgccacggaggaaagatatctttaaacaaaggataaataagattgtgcttccagctctagacactcgtcgtccgagtgctagttgttccaatttctggttagatctcaaccgaagtcaccaccatcaacaagtgccaccgtcgccgctctccaacgccgtcctccgcctcacagtccaaaattgttctcactttagatccattcccaatggttttgttgttgataatgctgttttgtcgttcaatcgcatgctccaaatgcgtcatactccatccattgttgaattcaataagatcttgactactcttatcaaaggtttgtgtcttaatggtaaggtcaatgaagctcttctttttcacgaccacgtgcttgcacttggatttcacttgaatcatgttacttatggtatcttgatcaatggattgtgtaaaatgggacaaacaagagccgccttacaagtgttgagacaaattgaagggaaattggtcaacaccaatgtgattaaaatggttgatgaagccttgaatctcttcacagaaatgcattgcaaacccaatacagtatcttacaacactcttattgatggattctgcaaatctgggagactttctcatgcttggaagcttcttgatcagatgcgtgatagaggccaacctcccaatgtaatcacttacaattccttattacatgctttatgtaaaaaccatcatgttgacaaggcaattgcattggtcaacaattttaaagaccaaggcattcaaccagatatgcacacatataatacacttgttgatggactatgcaaacaaggaagacttaaggacgcgcaactgatttttcaagatcttttgattaaaggctacaatttaccaacctggacatataatattatgatcaatggtctttgtttagagggcttgcttgatgaagctgagaccttgctgtcaaaaatggaagacaatggatgcatacctgatgttgtaacttatcaaaccattattcacgctctatttgaaaaggatgagaatgataaagcagagaaacttgtacgtgaattgattgttagaggtttactttaa

SEQ ID NO: 627 - DNA, 3258 bp, Medicago sativa
atgagtatgaggagaaagaacagagagttaaaaactcttctctctcgttctctccaattctcatcttcttcttcaaaacaccctctccacggtttacatcaccccaatgactccactttttccccttcaacacccacccctcgtgatttatcacaagactacgcatttctccgcaacactctcatcaactccacttccccacaatccactccttcttccggtgacgacgccatttcaacaatatcaaaagcactcaaaaccggtttcaacattgaaactcatcaattttttagacagtttcgtaatcagttaaacgactctttggtcgttgaagtcatgaacaatgtcaaaaaccctgagttgtgtgtgaagtttttcttgtgggctggtagacaaattggttacagtcacaccccccaagtgttcgataaattgcttgacttattaggatgcaatgtaaatgccgatgatagagtgcctttaaagtttttgatggaaattaaggatgatgatcatgaattgcttcgtagattgcttaattttctagttcgaaagtgttgtcgaaatgggtggtggaatatggctttggaagagttggggaggttgaaggattttgggtacaagccttctcaaactacttataatgctttgattcaagtttttcttagagctgataagttagatactgcttatttggttaagagagagatgttgagttatgcgtttgttatggataggtacactcttagttgttttgcttattcgttgtgtaaaggtgggaaatgtagggaagcttttgatttgattgatgaggctgaggactttgtgccggatacggtattttataataggatggtttctgggctgtgtgaagcttcactttttgaagaagcgatggatatcttacatagaatgaggtctagttcttgcattcccaatgttgttacttataggattttgctttctggttgtttgagaaaaggacagttggggaggtgtaagagaattctcagtatgatgattacagagggatgttatccgaatcgtgagatatttaattctcttatacatgcttattgtaaatcaagggattactcttatgcctacaagttgtttaagaaaatgataaaatgtgggtgccagccaggatatctggtttataatattttcattggtagtgtatgtagtaatgaggaacagcctagctcggatattttagatttggtggagaaagcttatagtgagatgcttgatttaggggttgtattaaataaggtcaatgtcagcaattttgcacggtgtctttgtggagctggaaagtttgatcaagcttttaagattatctgtgaaatgatgggcaagggttttgttcccgatgatagtacatattctaaagtgattggcttcctttgtgatgcctccaaggtagagaaagctttttcgttgttcgaagaaatgaaaaggaatggcattgttcccagcgtttacacttatactattttaattgatagcttttgcaaagctggtcttattcagcaggctcgcaaatggtttgatgaaatgttacacaaaggttgcacgccgaatgtggtgacttatactgctcttattcacgcatacctgaaagccaaacagatgcctgttgcagatgaactctttgagatgatgttgcttgaaggttgcaagcctaatgttgttacatatacagctttaattgatggtcattgtaaggctgggcagattgaaaaagcttgccagatctatgccagaatgcgaggtgacatagaatcctcagatatggacaaatattttaagctagaccacaacaactgtgaaggaccaaatgttattacatatggggctttggtggatggtttatgcaaagcaaacagggttaaagaggcacacgaattgttggataccatgttggctcatggttgtgagcctaaccaaatagtctatgatgctgttattgacgggttttgcaagatcggaaagcttcaggatgcacaggaggtgttcacaaagatgtcagagcgtggatacagtccaaatttatatacctatagctctttcatcgattgtctgtttaaagataaccggttggatcttgttttgaaagtgttgtcgaagatgctagagaattcttgcactccaaatgttgttatttacacagagatggtcgacggcctctgtaaaattggaaagacagatgaagcttacaagctcatgcttaagatggaagaaaagggttgtaatccaaatgttgtaacttataccgcaatgattgatggctttgggaaatcaggaaaaattgagcagtgccttgagctctttagagatatgtgctcaaaaggctgtgctccaaactttataacctatagagttttgataaatcattgttgttccaatggccttcttgatgaagcttacaaactcttggatgaaatgaaacaaacatattggccaaagcatatactaagtcaccgtaaaattattgagggcttcagccaagagtttataacctcaatcggacttttagatgagttgagtgagaatgaatcagtgcctgttgattctttgtacagaattttgatcgataattacatcaaggctgggagattggaagtcgcattggatcttcttgaagagatttcatcatcaccaagccatgcagtttccaacaaatatctatatgcttctttaatcgagaatctgtcacatgcaagtaaggttgataaagccttagaactgtatgctagcatgataagtaagaatgtcgttccagaacttagcatacttgtccacctcatcaaaggccttatcaaggttgataagtggcaagaagcactacaattatcggatagcatatgccaaatggatatccactggcttcaggaaaaggcaaccggtaggacagaagaaatggtcaagctggtaatagcagcaatggtggaagcagaaacaggagtttctgaagaaatcttggaaagatgttcttcatattccattaatgtccgaatcctgtgtttttttggtccacccatccatcattacatcatgcagcatgctaatagatctcaagaaagagttaaaattatgaggtgttccatttgtgcatcaaagaaccaagaaattaaggtcgatatagtgagttgtggaatgaactggttggtcgcaagtcagagttgtgataataacttctctgctcactccatatatccgacgtctgcagacttcacggcggtgggatcttaa

SEQ ID NO: 628 - DNA, 829 bp, Medicago sativa
gattcctacttccggcgccgcaaacatcaaccgaacaattcgccggcgacacattgaagccttttgcatcgcaaccatcaacccgtcacttccattaagaatgagaaaagaaggaaatgtgaaaggagctaagaatgcgttggctatgatgatcaaaggaagtataaaaccagatgttgttacatacaattcattaatggatgggtattgcctagttaatgaagtgaataaggccaaacatgttttaagcactattgctcgaatgggagtggctcctgatgctcagagctataatatcatggttaatggattctgtagaatctcccatgcttggaagcttgtcgatgagatgcatgttaatggtcaaccacctgacatatttacctacagttctttaatagatgctttatgcaaaaacaatcatcttgacaaagctattgcattagtcaagaaaattaaagaccaaggcattcaaccaaatatgtacacatacaatatacttattgatgggttatgcaaaggaggacgacttaagaatgcacaagatgtttttcaagatctattaactaagggttatagtctaaacatccgaacgtataatattttgatcaatggactttgtaaagagggcttgtttgataaagcagaggccttgttgtcaaaaatggaggataatgatatcaatcctaatgttgtaacttatgaaactattatccgctctctcttttataaagattacaatgaaaaggcggagaaacttcttcgtgaaatggttgctagaggtctattgtaagaatttactctagatttgctacctaagggacacgtt

SEQ ID NO: 629 - DNA, 1134 bp, Medicago sativa
atgaactctttgttgaaagatgggattactagtatggtatggaaggtttataagagaatggttcaagatggggttgttccgaatatttatgtttataattgtttaattcatgcttgttcgaaatcgagagatgtggagagagcagagtttatattgaatgagatggaagtgaagggtgtggttcctgatatttttacgtacaatactttgatagctttgtattgcaaaaagggtctgcattatgaggctttatcggtccaggataaaatggaaagagagggaataaatcttgatattgttagttacaattctcttatttatggattttgcaaagaagggaaaatgagggaagctatgaggatgtttggcgaaatcaaagatgccattccgaatcatgtcacatatactacattgattgatggatattgtaaagcgaatgagtttgaggaagctttgaggttgcgtgaaatgatggtggctaagggattgtaccctggtgttgttacttacaattcgattttgcgtaagctgtgttcagatggcagaataagggatgccaacaaactcttgcacgaaatgagtgaaaaaaaagtccaagctgacagtgtcacatcattgattcatggattctgcaaacaaagcgagctcgaaagtgccaaggaactattgtttggaatgctcgatgccggattttctccaaattatcgcacttattcgtggattgtagatagctattgcaagaaagacaatactgatgcagttctagcactgccagatgagtttttgagtaaagggaagggtatttcaggtgatagtgttatctacactagtcttgctttttcttactggaaatcagggaacacaaatgctgcctcagatatgttagaagagatggctaggagaaggttgatgatcactgtcaaaatctatagatgctttagtgctcttgatgctagtcaaaacaaagtgtcacagatgttctgggatcatgtcgtggaaagggaacaattgctgaatgagatgaatgtaaagggtgtgggcaggacactaactggcagaaccaacaaccaagggtcaaagattgtctgtcgtgtgcttcatgttttgaatggttgctggttgcatgcttcatga

SEQ ID NO: 630 - DNA, 2328 bp, Medicago sativa
atggtttgtggtgcacatgaattgtatgatgaggtgcttgaaagaggaatttatggcgattggaaaaaaaaaacagagaaatttgaggaggagttgagggaattgggatgggtaccgtatgaggatattgtgatggtgagcgttgatttaccgatgaatgtaattgttgcaagaagcttgatgaaaggatattgtgttctaggatatgtgattcttgcggcgcagttgtttgatgagattgttgagggaaggtatggtttcgaatccgattcgcgggtttttaattatttgttgaagagttttgttagagttaataagattacagatgctgttgagtgttttagaactatgttggagcatgatttggttccttgggttccgattatgaacaatcttttaactgcaatggttaggaggaatatggtttgtgatgcacgtcaactgtatgatgaaatggttgagagagggatttatggtgattgttatactttgcatgtggttatgcgcgcgtgtatgaaagaagggaaatttgaggaggttgagaagttttttaaggaggctaaggggagaggtttggaggttgatgcggctgcctatagcattttggttcaggcggtttgtcgaaggttggacttgaatttggcgtgtgagttgttgaaggagatgagggagtttgggtgggtgccatcaaagggtacatatactgctgttattgttgcttgtgtgaagcaggggaattttgtggaggcgttgaggcttaaggatgagatggtgagcgttggtttacctatgaacgtaattgttacgagaagcttaatgaaagggtattgtgtgctaggagatgtgaatcttgcgttgcagctgtttgatgaggttgttgagggtggtgttgttcccgatgtggttatattctcggttttgatcaatgggtgctctaaggttggggatatggagaaggcatatgaactgtatacacgaatgaaactcatgggcatccagcccaatgtcttcattgtaaattctctgttggaaggattccacgaacaaaatttgctagaacatgcgtatggattgtttgatgaggcagttgaacatggtatcaccaatgtcgttacgtataacattcttttgaagtggcttggtgaactgggaaaggttaatgaggcatgtaatttatgggaaaagatggtgagtaagggtattacaccttcgctagtttcttacaacaacttaatacttggtcactgcaaaaagggttgcatggataaagcctatagtatgttgaagagtattcttgaaaggggtttgaaaccaaatgctgttacatacactcttttaatagatgggtttttcaaaaagggagattcagagagagcctttgttgtgtttgagcaaatgatggctgcgaatattgcgcctactgaccacacatttaacactgtcataaatggcttgggtaaaactggccgggtgtctgagacacaggacaagttgaacaattttatcaagcagggttttgtatccacttccattacttataatagcatcatagatggatttttcaaggaaggtgcggtggattctgcacttcttgcctaccgggagatgtgcgaaagtggaatttctcctgatgtgatcacctacaccagtttgattgatggactttgtaaatctaataagattggtcttgctttggaaatgcatagtgatatgaagtacaagggtatgaaattggatgtcgttgcgtatagtgctctcattgacggtttttgcaaaatgcatgacatggaaagtgcaagcaaattcttcactgaacttttggacattggtttgactccaaacacagttgtttataacagcatgattagtggcttcatacatttgaataacatggaagccgcacttaacttgcaccaggaaatgataaagaataaggttccatgtgatttgcaggtatacacctcaataattggcgggcttttgaaagagggcaaattgagtttagctttagatctttactcggagatgctttccaaggatattgttcctgacatcgtcatgtatacagttctgataaacggactctctaacaatggacaactggaaaatgcaagcaagattctaaaggaaatggatgggaataatataactccttcggttcttgtttataacattttaattgctggaaacttcagggagggtaatctgcaagaggcttttagattgcatgatgagatgcttgataaaggtcttgtgcctgatgatactacatatgatattcttgtaaatggaaagctcaaggtatcacatactcttggtggatcttaa

SEQ ID NO: 631 - DNA, 1449 bp, Medicago sativa
atggaactcagaggaattcaaactgatcttgttaatctcaatatattggaaacccttcactttcatgatgatgttatagcaaaggggtttcaacttaatcaagttagttatgggaccttgattgatgggttatgcaaagcaggagaaacaagagctgccatgcaggataaacttgtaattgatgcttttgatttatattctcaaatgcttctcaagagaatttctcctgatgtcatcacttacaatactttaatgtatggctgtttgattgtgggtcgattgaaagaagcagttggagagatgaaaaaagctagaaatgtgttagctgttatgataaaacaaagtgtggatcctgatgtcattacttataattctttgatggatgggtatttcttggtcaaacaagagaataaggccacatttgtgttcaacactatggctagaaggggagtgactcctgatgttcatagctatagtgtcatgattaatggactatgtaagactaaaatggtggatgaagccgttaatctcctcaaagaaatgcattccaaaagtatggctcctaatactgtaacatacagttcacttatcgatggtcttcacaaatctgggagaatctttgatgcttgggatcttgtaaatgagatgcataatagaggccaacctgctgatgtgatcacttacaattccttattggatgctttgtgcaaaaaccatcaggttgacaaggcaatcacattacttacgaagatcaaagaccaaggaattcagccggatatatatacatacacaatacttgttgatggtttatgcaaaaatggaagactcaaggacgcgcaagagagcttgttcgataaagcattgtccttactgtcaaaaatggaagacaatggttgcacccctaatcctgtaactttcgaaattcttatccgtgctttgtttgaaaacgacatgaatgataaggcagtggaacttcttcgtgaaatgattgctagagatgagtcttcatctcttccggccacacatgatgattccggcacggtggtcgctggtggtggcaccaccgcgccggagttcaaaactccgtccaaatcaaatagttttcacgtgttgttccgatccggttcgaatcttgttgtggtaggctgtacgaactctccctctacctcttctaaaccgattctggatgttcttctttatgcgggaacgacgcgagtggtagatgatgtttatgtgattttatgcggtttagtgttcatgaggttcacggtttcagatctgaatacggtgatgatgatgaacgacggtgttgatgatgagattgaagattctggaaaccatttccacagcaaaatgggtttggatacggtgaagatgaccgtgatgatgatgaacgacagtgttgatgatgagattgaagattctagtggtgatgatgaacgacggtga

SEQ ID NO: 632 - DNA, 508 bp, Medicago sativa
gccagatgttgttacctacagttcattaatggatggatattgtcttgttaatgaagttaataaggccaaacatgtgttaagtatattatatctcgaatgagagtggctcccaatgctcgtagctatagtatcgtgattaatggattctgtaagattaaaatggtcgacaaagccttgagtctcttttatgaaatgcgttgcagaagaattgctcctgatacggtaacttacaattctctaattgatggtttgtgcaaatctgggagaatctcctatgcttgggagcttgttgatgagatgcgtgatagtggtcaaccagctgatataatcacttacaattcattaatagatgctttatgcaaaaaccatcatgttgacaaggctattgcattagtcaagaaaattaaagaccaaggcattcaactagatatgtacacatacaatatacttatcgatggactatgcaaacaaggaaggcttaacgatgcacaagtgatttttcacgatc

SEQ ID NO: 633 - DNA, 3093 bp, Medicago sativa
atggctagggacgaggatgagtggcaacgggttattagagaggataggatgcgcaacggcaaaacggcgagtaccgctagcgctcagaaggaaaaggtggatcaaaacccgtatgtcccgaagactcggaagcggatggacgcgaggccaggtgtagagagctcacaaccacatatggatcactcctcacaggtggttgatccgacacagacatatgagtatgcgaagggatttcggggatatgatcggatggaggaggatataatgttttatcagctgcaggacgaggcagaggatgaggaggtggcatgtgatgaggaggtgccagaggatgttgtggcggattatatagaggcagagaatgttgttcctgagggtgagcctgagcctgagcctcagactcagcaacgacgtcgtcgtgttccaccgatatcgccatatcctgttggagagcctccctatcctggaggacctgagaccacaccactgttgtcccactacgtgaggcacgtgacgaaccctctttggatgaactatcataatatgtggcatgatcagacgggttataagtgtataaatgcagggaaaaagatgaaagagcttggtaagccggagacgggtttgaggtggttttgggagcttgtggagggtagttttcatctacctgtgggggagatgacaatcactttggacaatgtgcataatctcctacacattcctattcacggccgcatgctggaccacgatgaagcaatgggtcaggagcgtgcgtttgatttgatgaccaggttgttggccatgtcagatgttgatgttagggctgagattaggactgagtctgctggtcatatcagttatcccacattgaagcgggtttatgaagaccacctgacagaggctagacggctggacgacccacatatgagggaggagttgcaggagagagccaggaggagacagtggtgtgtgaggagttttcttctatatctcgtcggttgtgcgctgttcactaacaaaacgaatagacacatcgacatgatatatcttgattgtatggtggacttgcagacgattgggaagtggtcatggggagggatggccttagcgtacctgtacgactatctggatgattatgttattctgaataacagaacgatagctgcgagaacgactctttttatgggatggattttggagcatttgtcaggtccgtacccaaggaagaaaaacaaggagtggacgctgaagagaccatgtgctgggagatggcttacatgcaaagggcataaagttgtgcaccattaccgctcatggcttgatcacttagaggtggatgacgagatggtgtaccgtcatttacctgagcgggtaaagaggcagcttttctatgtacaggatgttcccagacatccgtcatctgtcgctcaggtgcctacgcatttgctgcagaatgctcagatgtggttcttcactgcttggggagatgcgagcatgcctaacacactgacgatcatccgggatgtggtgcatatagctgatgatattgtggccagacaagccgagatgactaaagaggagattgtccaggaggtgatgcggatagccggtactggtcgccctgccgttacgtatcagattgccaagcggcgctgtgggtcgagtaaaactttgtttaagtggccaaagcaaattacaaattcactagttgagcagttaataaaagccgaaaaggacataaacaaaactcttgttatgtttgattctgcaacagaagagtatagcaatggatttcgtcatgatcacaatactttcggtgcaatgattcataggctagtttctgtgaatcagtttaggccagctgaaggaatgttggagagaatgaagcaagaagattgcgaggttactgaggacgtgtttttaactatatgtagaggctatggacgtgtgcataggccacttgatgccatcagggttttccataagatggaagattttcaggttaagccgacgcagaagtcttaccttacggtatttgatattctcgtggaggaaaaccatgtgaaaagggctattggtttttataaggagatgcgagaaaagggcattccgccaactgttgtttccctcaatattttgatcaaggcgctctgcaaaaacgaggaaactgttgagtctgcttttcgactatttcgtgaaatgcccaatcgtggatgccagcctgattcgtatacatatggtacgttgattaatgggctgtgcaaacttggaaaaatcagtcaggcaaaggaactgttggatgagatggaggagaaaggtttgtcgccttctgttgttagttacactagtttgatacatggcttgtgtcaatctaataatttggacgaagctatagaattgctcgaagagatgataataaatggcatcgagccaaatgtttttacatatagttctttaatggatggtttgtgtaaaagtggacattcttcacaagcaatggagttgttagaagtgatggttagaagacgtctattgcccaacatggtcacttatagtactttaatcaatggactgtgtaaagaaggaaagcatagagaagctgtggagattcttgacaggatgaggcttcaagggttgaaaccagatgcagggatgtacgggagaatcataagcggcctttgtgctgcttgcaactatcaagaagcagcaaacttcattgatgagatggctcttggtggtatctcacctaatcgagcaagttggacctttcatgtcaaaatgcataacatggttgtccaaggtctttgtaataatgttgatccaactcgcgcattccaattgtatcttagtatgcgtactaggggtatctctgttgagattggcacttttgattgtttagtcaaatgtttttgcaagagaggagacctgaataaagctgctcgaattctggaggagatgatattagatggctgcattccggatgagggaatgtggaatgtattaatgtgtggactttgggatcggaaaaaagttcgagaaactactgagctattggtggctgagctgaagcagaaatttgttgaagctgagagttga

SEQ ID NO: 634 - DNA, 1743 bp, Medicago sativa
atgggtcatcattcttcaacttcactcatctcttcccttattcaaaccgttccaactcatcatcgccataaccattctgttcttgtttttgatgctttgattattgcttatactgattctgaattcattgaggatgcaattcagtgtttaagattggttaaaaagaataacttttccattccggtttgtggttgtgattatttacttcgtcgtgtgatgaagttgaatcaacagcctggacattgttgggagttttatttggaggttttggattatgggtatccgccaaatgtttatctttttaacattttgatgcatgggttttgtaaaattggtgatgttatgaatgcacggatggtgtttgatgaaatttctagacggggtttgcgtcctagtgttgttagttttaatactttgataagtggatattgtagaagtaagaatgtggaggagggttttgtgttaaagagtgttatggagagtgaaagaatatctcctgatgtttttacttatagtgctttgatcaatgggttgtgtaaggagagtagggtggaggaggcgaatggtttgtttgatgaaatgtgtgagatgggtttggttcctaatggtgtaacgtttactactttgattgacgggcaatgtaaacatgggaagattgatttggcattgagaaattttgagataatgaaggatcggggtattagaccggatttgattacttataatgcgttgatcaatgggctttgtagggatggagatttgaaggaggctaggaagcttttgaatgagatgattgggaatggtttcaagccggataagatcactttcaccactctaatggatggatgttgtaaggacggagatatggattctgcattagaaatcaaggatagaatggttgaggaggggatcgagcttgacgatgttgcttttactgcactaatatctggactatgtagagacggaagagttcgcgatgctgagaggatgttgaaggacatgttgagtgccggtcacaaacctgatgatccaacatataccatggttattgattgcttttgtaagaaaggtgatgttaagatgggagccaagttactaaaggagatgcagcgtgatggacgtgtaccaggagtcgtcacttataatgcgctgatgaacggtttttgtaaacaagcaccgacacttcagattgaaggcgtgcttgagtgtccaacgcatatcggtattcaataccggcagaacactgacatcgacagattacagatcccttatgaaagaagatactttggctgttattctcaatgccagaagccagagttgagcgacagattacagatcccttatgaaagaagatactttggctgttattctcaatgccagaagccagagttgagagcaatctgctcctttatcagagcttccaaattccaatctcttttccaaacatcagataagatctatgtggatgttaagtggaattttcctgaggtggattgggtgagccattgtacggatgattccttcccgaggccaactcagattgctggttgtggaggatcgacccgaagtgagcatggggtctgggtttgcggcttctcacgaaaagtaaagaagctactgaagcatgtcataaaaatttcggaaggggattggattgtgaggataaagtatgtctttggaaaagcgaacaaatgtgcagactttcttgcaaacttatcaagtttctactttggtggtgcatga

SEQ ID NO: 635 - DNA, 1662 bp, Medicago sativa
atgatgctgaatccaacctatttcaccaccattctcttcacctctctccgcaattcatcctccaccaccacaaccttcctccttctctaccctttcacaaccttcttcgcacgcacccaccacaaaaaactccacaaactcccaaccttcaacgacaccgtttcatccttccaccacatcctccaccaccacccaccacctccaatccaacacttcaacaagctcctatcaaccctaattaaactcaaacgctacaacgccgtcgtttcactctacaccatcttacaatccaaaccaaccattaaaccctcactcatcacctttagtatattaatcaacgcttttgctcaattgggtcaaatgggttttgctttttcacttcttgggaacattctcaaaatgggttttcaaattgatgttagaatacttactactttgatgaaaggtttgtgcttgaaaggtagggttttggaagctgttagcttgcttcatgagtatgttgatagagggtttaggtttgatgaggtttgttatgggactattattaatgggttgtgtaaaattggtaaaactagggatgctattcagatgtttcctaagatgaaaaaaattagggtttatcctaatttgattatgtataatactgttattgatggtctttgtaaacaaggacttgttgacgaggcttgtggtttgtgtaccgagatggttgagaatggtattgaacttgatgtttatagttataattctatgattcatggtttttgttcggttggtaggtttcaagctgcggttaagttgctcgatgaaatggttgtaagggggaaggtttatccggatgtgtatacttttaatatattgattgacgggttgtgtaagctagggagggttagtgaagcgtataatgtggttgcggtgatgattaaaagaggttggaagccggatattgttagttataatgctttgatgaatggttattgtttgagtggaagtgtgggtgaggctaaacaggtgtttgataagatggttgagagaacggctttgcctaatgttattagttattgtactttgattaatggatattgtaaggttaggatggtggatgaagctatggtgttattaacggaaatgcataataagaatttagttccggatactgtaacttataattgtcttcttgatggtttgtcgaaatcgggaagatcgttgtatgagtgggacctggttgaggccatgcgagccagtggacaaccagctgatttaatcacttacaatgtattgttagatgattatttcaaacatgagaaatttgacaaggcacttgcattgtttcagcacattattgagatagggatttcaccaaacatacgcacgtataatatacttcttgatggtctttgcaaaagtggaagactaaagtatgcaaaagagatttttcaacttctgtctgccaaaggctgtcaaccaaatattcggacgtataacattatgatccatggtctttgtaaagagggttttttagacgaagcggaggccttactttataaaatgaattatctaaagatggggtacgagtatgttcgacagaagatttcactctgctggactaaaatctgggctaagatcctgttaactgggctcttgtacgatagcattctgtag

SEQ ID NO: 636 - DNA, 1693 bp, Medicago sativa
aactcaatctgatgcttcctcagcactcacatttttcaattgggttaaaaatgatttgaggttcacacttagtttgcagaattattgcttaattgttcacatacttggttggaatcaaatttttgatcaagccatgaaattgttgtgtgaattgatacaattgaacaatgtgaatgttgtttcttatgatgatgtttataagtgtttgattgattgtactgaggattgtaattggaatcctgtgatatttgatatgcttattaaggcttatgtgaaattaggtatggttgagaagggtttagagactttttggaagaatgttgagggtagttttgttcctaatgttgttgcttgtaattgtttgttgaatggtttgtctaagattaattatattggtgaatgttgggaagtgtatgaagaaatggggaggcttgggattcataggaatgggtatacttttaatattatgacgcatgttttgtgtagagagggagatagtgataaggtgaatggatttcttgagaagatggaggaagaaggatttgaaccggatttggttacatataatatacttattaatggttattgtaagaaaagaaggttggaggatgcattttatttgtataagattatgggcattagaggtgtggttcctaatttgatttcgtatagtgcgttgatgaacggtctttgtaaagaaggcaagattaaggaggctcatcaactttttaatcagatggttcaaagagggattgatccggatgttgtgtcgtataatacacttatatctggttattgtaaagaaggtggtaagatgcaaatgtgtagatcactattgcatgaaatgataggaatcgggattcgtccggacaatgttacttgtaggattgtttttcaaggatatacaagggagggaaagcttttatcggcgttgaatatggttgcggaacttcagaggtttggaattaagatccctgaaaatttatatgattatctcttagttgcattgtgtaaagaaggtcggccgtttgcggcacgaagctttctgataaggatatctcaagatggagactatgtgcctgaaatgagcacttacattaaactagcagagtctctatgttcgttcaataatgtggaagaggcactgattttgaaatctgagatggcaaaaaagagtatgaaactaaatctcactacctataaagctatcataagctgcttgtgtagagtaaaaaggacttcagaggctgaaaacttgttggaggaaatggttagtttaggtattctacctgatttagaaataaagagggcattaataaatggatattgtgaagaaaacgatgttgataaagctgtgtcgttattgaaattctttgccaaggagtttcaagtttacgataccgaaagctacaatgcaattgttaaagtcttttgcgaggtcggtaatgtggctgagttgatggagcttcaagataagcttgtcaagatagggtatgttccaaatagtttaacatgtaagtacgttatccgaggattgcagaaaggtatggaactcgatgatgatgatgatatatcggacggcgacatgcttgaatatctaagcactcggggaaccgagccttatacagctattgagggggaagaatcaagtcgcttaaatgcttcaccgagtattcctgattacttgatttga

SEQ ID NO: 637 - DNA, 2364 bp, Medicago sativa
atgttgatttatacttataaagattggggttcacaccctcttgtgtttgatttgtattttcaagtgcttgtggaaaatgggttgtcttgtaattttgaggggattaagattgcggttaaggtgttcgaggaatttcctgaattgggtgtttgttggaatacagtttcgtgtaatattgttcttcattgtctttgtcaattggggaaggtgagagaagcacataacctgcttgtacaaatgacggatagaggaaattttcccgatgttgtaagttatggtgttgttgttagcggatattgtagaattggtgagttggataaggttttgaagcttgtcgatgagttaaaaggaaaggggttgaaaccagatgaatacatttacaataacataattttacttctttgtaagaatggtgaagtagttgaagcggagcaactgttgagggggatgaggaaatggggtgtttttcctgataatgtagtgtatacgactgtcattagcggtttctgcaagttggggaatgtttcggctgcgtgcaaactgtttgatgaaatgaggcgtaagaaaatagttcccgacattgtcacttatacttctgtgattcatgggatttgtaagagtgggaaaatggtagaagcgcgtgaaatgtttaatgaaatgttggtgaaagggttggagccggatgaagttacttatactgcacttattgatgggtattgcaaggctggtgaaatgaaagaagctttctctgttcacaatcagatggttcagaagggtctgactcctaatgttgtcacttatactgcattggctgacggtctatgtaagaacggagagatcgacgtagcgaatgagcttcttcatgagatgtctagaaaaggacttcaaccgaatgtctacacgtataatacgatcgttaatggtctttgtaagataggaaatatagaacaaacagttaaacttatggaagaaatggatctggcagggttttatcccgacactattacatacactacactcatggatgcatattgtaagatgggggaaatggccaaggctcacgagttgctgcggattatgctcaataaaagacttcaacctacacttgttacattcaatgtgctaatgaatggattttgcatgtctgggatgttggaagatggtgaaaggttaatcgaatggatgttggagaaaggtataatgccaaatgccacgacatttaattctcttatgaagcagtactgcattaaaaataacatgcgagcaactaccgagatttacaaggctatgcacgatcgaggagtgatgcctgacagtaacacttataatattttgatcaaagggcattgtaaagctagaaatatgaaagaagcatggttcctgcataaagaaatggttgaaaaaggatatagtgtcactgcggctacctatgatgcacttataagaggtttttataagaggaagaaatttgtggaagctaggaagttgtttgaggagatgagaaaacatggtttggttgctgagaaagatatatatgatatttttgtcgatgtgaactatgaagaagggaactgggaaataactctcgagctttgtgatgaagcaatagagaaatctgttttccgaattgtaaataccagtgaggaaaaaatggaacttagtttgagaatagatgatatattctcattggttaatcttccattatctgcgttcttttttgtcatatccattagagggtcatcagggattcttgtgataagaatatccgatgtagtagcgacatatacatcagttccgactgatggaaatttgagtccttatgctgcttcaccctatatggttgatgccattgcaagtagctgtggcattggatatccaatttcaatggcaatgagtgatgtgaagcttattggcaaatggtcaagtccttatgtgacaagggtgaagattgcccttaacatcaaatcccttgaatatgaaaactttgaagagaatgaaacctttaaccccaaaagtgatattcttcttcaatccaaccctatttatggcaaagtcccagtgcttattcaccaagatagaccaatctgcgagtctctcatcattgttgaatatatagatgaaacatggtccagtgctccttctattctcccttctgatacttatgatagagcacttgcaagattctgggctgcttatatagatcaaaagtggtttcctcctatgcaaagcataattactgttgaaggagaggatgaaagaaagccatattttgaggtattggaagaagtggtcgagaggatggaggaagcttttgacaaatgcagcaaaggaaagccctttttcggtggtgataggattggttaa

SEQ ID NO: 638 - DNA, 2613 bp, Medicago sativa
atggaagaaacaacaagaaaactaataaaatccattcaccaaaacacaaacaacccaaaactcgcatggcatctcttcaaacgaatcctctcttcatctccctcatcctcatcctcatcctcatcctcttcctcttcccatcatcaccacctcattcccaccatcacacgcatccttctccgccacaacatggacaacgaaatcaaccatctctttcaactcaccacatcacaccattcccacatttcaattctcaatatcttatcccaatcaccccaccatctcgatttcgctttctcccatttcaaatcactcagaacccatttcccatcaacccctcttcctcttcaactctaccacctcctcctccgttccagcctccaacagaatcgtccacattacgttacttcgttgtacactgacatgattcaaactggtgttaacccggaaacatatacttttaatcttttgatacagtcgttatgtgaatctaacgcgcttgatcatgcacgtgaactgtttgataaaatgtctgaaaagggttgtcagcctaataagttcactgttgggatacttgttcgtgggttttgtcgagctgggagaactaaacaggctttggagtttgttgatgggaagatgggggggaatgttaatagggttgtgtataatactcttgtgtcgagtttttgtaaacaggatatgaatgacgaggcggagaaattggttgagaggatgacggagaagggtttgttacctgatgttgttacgtttaattcgaggatatctgcactttgtagagcggggaaggtttttgaggcgtcgagaatttttagagatatgcagatggatggggaattgggacttcctaagccgaatgttgttacttttaatttgatgcttaaggggttttgtcaagaagggatgatggaggaagctaggtctttggttgagactatgaagaaaggtgggaattttgttagtttggagagttataatacttggttgttgggtttgcttagaaatgggaagttgttggagggtcgatcggttcttgatgaaatggtggagaatggtattgaaccgaatatttactcgtataatattgtgatggatggactgtgtaggaaccatatgatgttggatgcgagaaggttgatggatttgatggtgagtaatggtgtttacccggatactgttacttatactactctactacatggctattgtagcaaagggaaggtttttgaagctaaagcgattcttaatgaaatgattaggaaaggttgtcatccaaatacttatacttgcaatacgttgctgaatagcctgtggaaagaggggaggaagtcagaggctgaggaaatgctgcaaaagatgaacgaaaagagttatcagttagatactgtgacctgtaatatcgtggtcaatggtctgtgtagaaacggagaattggagaaagcaagtgaagttgtaagtgagatgtggactgatggaacaaattcccttggtaaagaaaacccagttgctggcctagttaattcaatccacaatgtatcgaccaatgtgcctgatgtgatcacttatacaaccttaattaatggactttgcaaggttgggaaactagaagaagccaaaaagaaatttattgagatgatggcgaaaaacttgcaccctgattctgtgacctatgatacgtttgtattgaatttctgcaaacaagggaagatatcatcggctttacgtgtattgaaagacatggagagaaatggttgcagcaagactcttcaaacttataattcattgatcttggggttaggaagtaaagggcaaatatttgaaatgtacggattgatggatgagatgagagaaagaggaatacatccagatatttgcacttacaataatatgatcaattgtctctgcgaaggagggaaaacaaaggatgccacttctcttttacatgaaatgttggataagggagtcgtctctcccaatgtatcttccttcaaaatattgattaaagcattctgcaagtctggagattttaaagtagcatgtgaactttttgatgtagctctgagtgtatgtggccacaaagaagccttgtacagtttgatgttcaatgaattacttgctgggggaaaactctctgatgcaaaagagctatttgaagcttcattagaaagatctctcttatcaaagaatttcatgtatgaagatttgattgacaaactttgcaaggatggaaggttagacgatgctcacggccttcttcagaaattgattgataagggatattgcttcgaccattcatcattcatacctgtgattgatggcttaagtaaaaggggaaacaaacaacaagctgatgaactaggaaggataatggaattggctttagaagataaaacttctgataggacttaccgaaatggaaactccatctttcgtcgaaaattacacaaggatggtggaagtgattggcaggatataattaacagggatattggcggtaatattgcattgaaaactctgaagcgtgtagaaaaaggctggggtcaaggaagtatatcgagtttgctgcctcaaaagaatgattatcttgattactaa

SEQ ID NO: 639 - DNA, 693 bp, Medicago sativa
atggtggatgaagctgtcaatctcttcaaagaattgcatttaaaaaacatggctcctgatattgtagcatacagttcacttattgatggactttgcaaatcggggaaaatatctgatgtttgggatcttatagatgatatgcatgatagaggtcaacaagctgacataatcatttacacctcgttattggatgcattgtttaaaaaccatcaagttgacaaggcaattgcgttattgaagaagatcaaagaccggggaattgaaccagatatgttcacatacacaatgcttgttgatggactatgcaaaaatggaagacttaaggatgcacaagaggtttatcgggatcttatggttaagggctatcattttaatgcttgcatgcataatgtcatgattaatgggctttgtaaagagggcttgtttgacgaagcattgtttgtactgtccgaaatggaagacaatggttgcacacctgatgttgtaacttacaaaactcttatccgtgctttgttcaaaaacgacatgaatgataaggccgtgaaactcctccgtgaaatgctttctagaggtctactgtatggccgtatgggtcctaaaggaggaattagcaactctgaaattgactctggaggaataaacaactgtgaaattgactcttggagtctcatgatgctttcgcatttacattaa

SEQ ID NO: 640 - DNA, 1432 bp, Medicago sativa
atggggaggaaaaatggagaggatcccaactcgtctgcagggggagagggaatggccttggattggctagagtcaaacaaaaagcttgaatttactgagaaagagtatgcttctaaacttgatttgattgccaaattgcgtggcctaccaaaggcagaaaaatacctcgagcatgttccaaattctttcagaggagaattattatacagaacattactagctaactgtgctagtctggaaaatttgaggaaaacggaggaaacattcaacaaaatgagggagttaggttttcctgttacagcatttgcttgcaatcagttgcttctcatttataagaagattgacaagaagaaaatagctgacgtgttacttatgatggaaaaggagaatgtcaaaccttcttcttatacttacaaaattttaatagacgtgaagggcctgtctaatgatattgatgggatgtctcaaattgttgagacaatgaaggcagaaggttgtgaactagaccatctaacacgggcatccttggccaggcattatgccgcagctgggcttaccgaaaaaactgaagctatattgaaggagattgaaggtgaaaacttaaaagagaatatgtgggtatgcccaactttgcttcgcctttatgcaattctgggtagggctgatgaagtggagagaatttggaaggtttgtgagtcaaagccacgggttgaggactgccttgccgcaattgaagcttggggaagattgaagaaaattgaagaagcagaggcagtttttgagatgatgtcaaataaatggaaacttactgccaggaattacgaatcactcctgaaaatttatataaggcataagatgctaaacaagggtaaggatcttattaagacaatgggagatagtggatgcacaataggtccaacaacctgggatgcacttgtgtctctttatgttcaagcaggggaagtcgaaaaggcagacactgttttgcagaaggcactacagcaaaataagatgaagccaatgtttactacttttatgactattatggagcagtatgcaaagaggggcgacgtccataatgcagagaagattttctatagattgagacaagctaattatatttctagaatatctccgttccatgctctagcacaggcttataaaaacgccaaactaccggcatatgggatcagggagaggatgaaagctgataacctattccccaacaaagctttggctgaccagttggtgcaagttgatccgtttaggaaaactccagtttctgatttgcttgattgaggagattagcatattatctcttgtgcttcaacttttcaaatgcaactattattagttagtttgatggtaagattgaacttcccgaatttgaatattttgtcttgtactgattaatgcattaatagggttttat

SEQ ID NO: 641 - DNA, 6561 bp, Medicago sativa
atggaagaagagaacacgcagctccgtaccgaattggcatctctaagggaggaattggccaaagctcatgatgctatgactgctctgttggctgctcaagaacaaccaactcctatagtttctgcagctgcaaattacttgactcaagccgcaacaactgttaccgagcccattgtgaatacggtgcctcaatttgtccatattaatgcgcaccgcgggagtattgccacaaccggaactatggaagagaggatggaagagcttgccaaagagctccgacgggaaattaaggccaacaggggaaacggagactccattaaaacccaggatctctgcttagtatcgaaggtagatgttccaaaaaagtttaaagtcccggagttcgacaaatataacgggctgacttgtcctcaaaatcatattgtcaaatatgtccggaagatgggcaactacaaggacaatgattcccttatgatccattacttccaagacagtctgatggaagatgctgcagagtggtatactagtctgagcaaagatgatgtccacacttttgatgagctagcagccgctttcaaaagccattatgggttcaatacaagactgaagccaaatagggagtttctcaggtccctatctcagaagaaggaggaaagtttccgtgaatacgcgcaaaggtggagaggggcagctgcccgtatcactcctgctttagatgaagaagaaatgactcagacatttctgaagactctcaagagggattatgttgaaaggatgattatcgcagccccaaacaatttctcagagatggttaccatgggaacacgtctggaagaagctgttcgggaaggcatcatcgtgtttgagaagattgagtcatctgcaaatgctgtgaagagatatggtaatggacatcacaagaagaaagatacggaggtgggaatgatagccgctggaactaatccatccaaggctactgttgctcctatcaatgctgctcagtttcccccgtcctacccttatgcaccgtactctcagcatccgttcttcccaccgttttatcatcagtaccctttgccaccgggccaacctcaggtccctgtcaatgccatcgctcaacaggtgcaacatcaaccgccagttcaacagcagcagcaacaatatgctagaccaacttttcctcctataccaatgttgtatgcagagcttcttccaactttactccagagaggacactgcacgactaggcagggcaagcctccaccggaccctttacctccaaggttccgctctgatcttaagtgtgacttccatcaaggcgctttagggcatgatgttgaggggtgctatgctctaaagtacatcgtcaagaagcttatagatcaagggaagttaacttttgagaacaatgtgccacatgtcctcgataatccgctcccaaatcatgatgccgtgaatatgattgagatatgtgaagaggttcccatgctggatgtccgcaatgttgcaactcctctggtgccactccatatcaagttgtgccaagctttattgtttgaacatgatcatgctgagtgccaagaatgttcccgcaaccctttgggctgccatgtcgtccaaaacgatgtccagagcttgatggacggcaattaccttactgtcagtgatgtttgcgtaattgtgccggtctttcacgatccacctgttaagagggtgcctttgagggagagcgttgagccgttggtgataaggttgccaggaccaattccttatgtttcggacaaggctgttccatacaaatacaatgctactatgatagaaaatggagtggaggtgcctctagcctcctttgccacagtaagcaatattgccgaagggacttctgcagcgctaagaagcgggaaggtccgtccgccgttatttcagaagaaggtagctacgccaaccactccaccagttgaagaagcaactccaaccgttgtttcacccattgctacagatgtgaaccagccaggcaaatctatagaggattcgaatttagatgagattctgaggataataaagaggagcgattacaagatcgttgatcaattgctgcaaactccttcaaagatatctgtcttgtcgttactcttgagctctgaggctcacatgaataccttgttgaaagtgctggagcaggcttatgttgaccacgaagtcacggtagatcgtttcggtggcatagtgggaaatattactgcttgtaacaacctctggtttagtgaggaagagttgccgaaagtgggaaagagtcacaatctggctttgcacatctcggtgaattgcaaatcagacatgatatcaaatgtgttggtggataccggttcctccctcaatgtaatgcccaagtcaactctagatcagttgagctaccgagggatccctttaaggaggagtactttcttggtcaaagcttttgacggatctcgaaagaatgtgctgggggagatagacttgccgataaccattggccctgagaatttcttgattaccttccaagtgatggacgttaatgcatcctacagttgtctgctgggaagaccgtggatacacgatgcgggtgcggtaacctccaccttacatcagaagttgaagttcataaggaatggaaagcttgttaccattcatggagaggaggcatacctggttagccagctatcatctttctcttgcatagaagcagggtctgcagaggggaccgcttttcaaggattaactgtcgaaggtacggagcccaagagggatggaactgccatggcttctttgaaggatgcacagagagccgtccaagagggtcaagctgccggctggggcaagttaatacagcttcgtgagaacaagcataaggaaggtcttggcttttccccaacttcaggagtttccaccggggcattctgtagtgctgggtttgtcaacgcaatcacagaagaagcaactggatttggcccgaggcctgtatttgttataccaggaggcattgcgagagattgggatgccattgacattccctcaatcatgcatgtttctgaattgaactataatgaacccgttgggcacagtaatcctgcattctctccgaattttgaattcccagtgtatgaagccgaagatgaggaaggtaatgatataccatacgagatcacccggctacttgagcaagaaaagaaagccattcagcctcaccaagaagagattgagctcatcaacataggtaccgaggagaacaagcaagagatcaagatcggtgctgctctagaggaaggggttataaagaagatcatccaactcctccgggaatatccggatatttttgcatggtcgtatgaagatatgccaggtctagatcctatgattgtggaacatcggatccccaccaagcctgaatgtcctcccgtcaggcagaaattgagaaggactcatccagatatggctctcaagattaagagcgaggttcaaaaacagattgatgcgggtttcctcatgacagttgagtaccctgaatgggttgctaatattgtacctgtgccaaagaaggatggtaaagtccggatgtgtgttgacttcagagacctgaacaaagtcagtccaaaagacaactttccattacctcatattgatgtgcttgttgataatactgctcagtctaaggtgttctccttcatggacggtttctccggttacaatcagatcaaaatgtctcctgaagatagagaaaagacgtcttttatcactccatggggtactttctgctacaaagtgatgccgttcggcctaataaatgctggtgctacctaccaaagagggatgactactctgtttcatgacatgattcacaaagaagtcgaagtatatgtggatgatatgattgtaaagtcaacagatgaggagcaacatgttgaatatttgacaaagatgtttgaaaggttgagaaaatacaagcttcgattgaatcccaacaaatgtacattcggcgtcagatccgggaagttattaggcttcattgtcagccaaaagggcattgaagtcgatcctgataaagtccgggccatccgagaaatgccagctccacagaccgagaagcaagtcagaggtttcctcggacgtttgaattacatctcccgattcatatctcacatgaccgcaacctgcgggccgatcttcaagctactcagaaagaatcagcctgttgtatggaatgatgaatgccaagaagcttttgatagcatcaagaattacctgctggaaccacctatccttgtcccacccgtggaaggaaggcctttgattatgtatttggcagtatttgatgaatccatgggatgcgtacttggtcaacaagatgagactggaaagaaagaacatgctatctactatctaagcaagaagttcaccgattgtgaaactcggtatacaatgcttgagaagacttgttgtgctctggcctgggccgctaaacgcctgcgtcattatttggtgaatcatacaacttggttgatatccagaatggatccgataaagtatatctttgagaaagctgctgttactgggaagattgcacgctggcagatgcttttgtctgaatatgatattgtgttcaaaactcaaaaggcaatcaaaggtagcattcttgccgatcaccttgcttaccaacctcttgatgattatcaaccaattgagttcaatttccccgatgaggagatcatgtatttgaaatcaaaagactgcgaagaaccgttgattggtgaaggtccagatcccaatggcaagtggggtttagtctttgatggtgctgtcaatgcttatggtaaaggaattggggcagtcattgtatccccgcaggggtatcacattccttttaccgccagaattctattcgaatgtacaaacaatatggctgagtatgaagcatgtatcttcgggatcgaggaagcaattgacatgagaatcaaacacctcgacatctatggagattctgcgctcgtcatcaatcagataaagggtgaatgggagacccaccatgccaagttggttccttatcgtgattatgcgagacgtttgctgacatattttacaaaggttgagctgcaccatattcctcgtgacgagaacaaaatggctgatgctcttgctactctatcctccatgtttcgagtaaaccattggaatgatgtgccactaatcaaagtgcaacgccttgaaagaccttcacatgtgtttgctattggggatgtgatcgatcaggctggcgaaaatgtgattgactataaaccctggtactacgacatcaaacagttcttgctgagccgtgagtatccgccgggtgcttccaaacaagacaagaagaccttgagaagattggccagtagattcctgttagatggagatattctgtacaagaggaactatgacatggtattgttaagatgtgttgatgaacatgaagcggagcagttaatgcatgatgtacatgacggtaccttcgggacccatgctacagggcataccatgtcaaggaagttgttacgggcaggttactactggatagccatggagcatgattgctaccagcacgccagaaagtgccacaaatgtcaaatctatgctgataagattcatgtgcctccgcacgctctcaatgttatttcatccccatggccgttctcaatgtggggcatcgacatgattggaagaattgaaccgaaggcttcaaatggtcatcgtttcatcttagtggcaattgactacttcactaagtgggttgaagcagcatcttataccaatgtgaccaagcaagtggtagctaagttcatcaagaacaatatcatatgtcgatatggtgttcccagcaagattattaccgacaatggtaccaacctgaataacaatgtggtgcaagctctttgtgaagaattcaaaattgagcatcataactcttctccttatagacctcagatgaatggtgcagttgaggccgccaacaagaatatcaagagaattgtccagaagatggtaaccacttacaaggactggcatgagatgttaccctatgctctgcatggctaccgtactaccgtgcgcagttcaaccggggcaacccctttctctcttgtatatggtatggaagcagttcttcctttggaagtggagatcccatctctccgtgtgattatggaagcaaagttatccgaggctgaatggtgccaaagccggtatgatcagttgaatttgattgaggaaaaacgtatggatgccatggctcgtggacagtcatatcaagcaagaatgaagactgcctttgacaagaaagtccatcctcgagaattcaaggtaggggaacttgtattgaaaaggaggataagccagcaacccgacccaaggggcaagtggacgcctaactatgaaggtccttatgttgtcaagaaggccttctccggtggtgctttaatccttacacacatggacggtgtagagcttccaaatccagcgaatgccgatatagtcaagaaatactttgcctag

SEQ ID NO: 642 - DNA, 8139 bp, Medicago sativa
atgaagaagactaaatgctacaagttcaaggaagtggatttggtcagtttaagagagttggcactcaaggtcaagagtcaaacagggttccgactccggtatgggggattgcttactttgctccgaaccgatgtggaagagaagctagtgcacactctagtgcaattttatgatccgagcttccgttgcttaactttcccggacttccagttggttcctactctcgaggcttactccaatctagtgggtttacctatagccgagaagacgcctttcaccggtcccgggacttctcttactcctctggttattgctaaggatctctatctcaagacttctgatgtctccaaccatcttgttaccaagtctcacatccgggggttcacttcgaagtatcttcttgagcaggctaatctcagtactacttgtcaggatacactcgaggctattcttgctttgcttatctacgggctcattctctttccgaacctcgacaacttcgtggacatgaatgctatcgaggtcttccattccaagaacccggttcctactttgctagcggatacctaccacgccattcatgacaggactctcaagggccgtgggtatattctttgctgcatatctcttttgtataggtggtttatttcgcaccttccgagttccttccatgacaactcggagaactggtcctactcgcagcggattatggccctcactcctaatgaggtcgtctggctcactcctgccgctcaggtgaaggaaatcattatgggttgtggagactttctcaatgtacctcttcttggtacccgtggaggaatcaactacaaccccgagcttgctatgagacagtttggtttccctatgaagtcgaagcccatcaatcttgctacatctccagagttcttcttctacacgaatgctcctaccggacaaaggaaagctttcatggatgcttggtccaaggttcgaaggaagagtgtgaagcatctaggtgtgagatccggtgttgcttatgaggcctatactcagtgggtgatagatcgagctgaggagattggtatgccttatccagctatgagatacgtgtcttcatctgctccatctatgcccctacctctactccccacgacccaggatgtgtatcaggagcatctagctatggagagtcgtgagaagcaagtgtggaaagctcggtacaatcaagctgagaatctaatcatgactttggatggtagagatgagcagaagactcatgagaacctgatgttgaagaaggaactagctaaggtccggagagaattggaagagaaagacgagctgcttatgagggattccaagagagccagaggacgacgagacttctttgccagatactgtgattcagattccgagtccgatgattctccgactacttcctatgtctacgaacctgacagaatcgatcgaaccagagaatacagaagaaggaaaaaggctatggaagaagagaacgctcagctccgtaccgagttagccactctaagggaggaattggctaaagctaatgatgtcatgactgctctgctagccgctcaagaacaatcagctacggctatccctatagccacagctgcaccggtgactacaagcgtgctcccaaccgcatctgcagacgctcgccttgctatgccagccgggtttccgtatgggcttccaccgttcttcactcccagtactgcagcgggcacttcgggcactgctaacaatgttctgatccctgcaacaaatgttggctccatcaatgctactttgccacaaacaacggcagctgtcactgagcctcttgtgcataccatgcttcaaagtgttaacatcaacacacaacacggaagcatccccgtaaccaaaaccatggaagagatgatggaggaacttgctaaagaactcgtcatgagatcaaagccaatcgaggaaatgcggactctttcaaaactcaagatctctgcttggtgtcaaaagtggatgtccctaaaaagttcaaaatcccggatttcgaccgatgccgcagagtggtatactagtttgagcaaaaatgatatccataccttcgatgaattagccgctgctttcaagagccactacgggtttaacacccgattgaagccgaacagggaattcctcagatctctctctcagaagaaggaggaaagcttccgtgaatacgcacaaagatggaggggggcagctgcccgcattactcccgctcttgatgaagaagaaatgacccagacattcttaaagaccttgaagaaggattatgttgagagaatgatcatagctgccccgaataacttttcggagatggtcaccatgggaacccgtctggagaaagccgtcagggatggaatcattgtgttcgagaaagctgaatcctctgtgaatgcatcgaagaggtatggtaatggacaccacaagaagaaagaaacggaagtagggatggtgtcagctggagccggtcaatccatggctactgttgctcctatcaatgcagctcaaatgcctccgtcatacccatatgtgccgtattctcagcatcctttctttccgccattttatcatcagtaccctctgccaccgggtcaacctcaagtacccgtcaatgcaattgctcaacagacgaaacaacagttgccggttcaacaacaacaacaaaatcagcaagctagacctactttccctccgataccgatgttgtatgctgagttgcttccgactttactccatagagggcattgtacaaccagacagggcaagcccccacctgatccgttgcctccaaggttcaggtctgatctcaaatgtgattttcatcaaggcgccctgggtcatgatgtcgaggggtgctacgctttgaagtatatcgtgaaaaagcttattgatcaaggaaagctgacttttgagaataatgtcccacacgtcctcgacaatcctcttccaaatcatgccgctgtgaatatgatcgaagtatgtgaggaagctcctagacttgatgtccgtaacgtcgcaactcctctggtgcctctacacatcaagctgtgcaaagcttctctgttcagccatgatcatgccaagtgcctaggatgccttcgtaatcctttgggttgctatactgttcaagataacatccaaagcttgatgaatgataattttttgactgtcagtgacgtctgcgtgattgtgccagtttttcacgatccgcctgtcaagagtatacctttgaagaagaatgctgagcctttggtgataaggttgcccggaccggtaccgtatacttcagatagggctatcccgtacaagtataatgctaccataattgaagacggagtagaagtgcctctggtgtccttggctgtggtgaacaatactgccgaaggaacttcagcagccctcagaagcggaatagtccgtccaccattgtttcaaaagaaggcagctacgcctaccgtgccacccattgacgagccaaccccgactgatgtttctcccgttaacagagacgtgggccaaccaggccggtctatagaggattctaatctggacgagattttgaggttgatcaaaagaagtgattacaagattgtggatcagctgttgcaaactccgtcgaagatatccattttgtctctactcctgagttccgctgcccacagagatacccttttgaaattattggagcaggcttatgtggatcatgaggtaactgtggatcactttggtagcatagtgggaaacattaccgcctgcagcaacctgtggttcagtgaagatgaattgcccgaagcaggaaagcatcataatctggccttgcatatctctgtgaattgcaagtccgacatgatctcaaatgtgttagtagacactagttcatctttgaacgtgatgcccaagtcaacgctggatcaactgagttaccggggaactcctttgagggagagcacttttctggtcaaagcctttgatggaacccgcaagagcgttctcggggagatagacttgccaataactatcggccccgaaacctttctaatcacctttcaggtcatggatattaatgcctcttacagttgcctcttggggaaaccatggatacacgacgcgggagcagtgacctctactttgcaccaaaagttgaaatttgcaaaaaatggaaagcttgttaccattcatggagaggaagcatacctggttagtcagctatcatctttctcttgcatagaagcagggtctgcagaggggaccgcttttcaaggattaactgtcgaaggtacggagcccaagagggatggaactgcaatggcttctttgaaggatgcacagagagccgtccaagagggtcaagctgccggctggggcaggttaatacagcttcgtgagaacaagcataaggaaggtcttggcttttccccaacttcaggagtttccaccggggcattctatagtgctgggtttgtcaacgcaatcacagaagaagcaactggatttggcccgaggcctgtatttgttacaccaggaggcattgcgagagattgggatgccattgacattccctcaatcatgcatgtttctgataaccttgcattccctccgaattttgagttcccagtgtatgaggccgacgatgaggaaggtgatgacataccatatgagatcactcggctacttgagcaagaaaagaaagccattcagcctcaccaagaagagattgagctcattaacataggtaccgaggagaacaagcgagaaatcaagatcggtgctgctctagaggaaggggttaaaaagaagatcatccaactcctccgggaatatccggatatttttgcatggtcgtatgaagatatgccaggtctagatcctatgattgtggaacatcggatccccaccaagcctgaatgtcctcccgtcaggcaaaaattgagaaggactcatccagatatggctctcaagattaagagcgaggttcaaaaacagattgatgcgggtttcctcatgacagttgagtaccctgaatgggttgccaatattgtacctgtgccaaagaaggacggtaaagtccggatgtgtgttgacttcagagacctgaacaaagccagtccaaaagacaactttccattacctcatattgatgtgcttgttgataatactgctcagtctaaggtgttttccttcatggacggtttctccggttacaatcagatcaaaatgtctcctgaagatagagaaaagacgtcttttatcactccatggggtactttctgctacaaagtgatgtcgttcggtctaattaatgctggtgctacctatcaaagaggaatgactactctgtttcatgacatgattcacaaagaagtcgaagtatatgtggatgatatgattgtgaagtcaacagatgaggagcaacatgttgaatatttgacaaagatgtttgaaaggttaagaaaatacaagcttcgattgaatcccaacaaatgtacattcggcgtcagatccggaaagttattaggcttcattgtcagccaaaaaggcattgaagtcgatcctgataaagtccgggccatccgagaaatgccagctccacagaccgagaagcaagtcagaggtttcctcggacgtttgaattacatctcccgattcatatctcacatgaccgcaacctgcgggccgatcttcaagctactcagaaagaatcagcctgttgtttggaataatgaatgtcaagaagcttttgatagcatcaagaattacctgctgaaaccacctatctttgtcccacccgtggaaggaaggcctctgattatgtatttggcagtatttgatgaatccatgggatgcgtacttggtcaacaagatgagactggaaagaaagaacatgctatctactatctaagcaagaagttcaccgattgcgaaactcggtatacaatgcttgagaagacctgttgtgctctggcctgggccgctaaacgcctgcgtcattatttggtgagtcatacaacttggttgatatccagaatggatccgataaagtatatctttgagaaagcggctgttactgggaagattgcacgctggcagatgcttttgtctgaatatgatattgtgttcaaaactcaaaaggcaatcaaaggtagcattcttgccgatcaccttgcttaccaacctcttgatgattaccaaccaattgaattcgatttccccgatgaagagatcatgtatttaaaatcaaaagactgcgaagaaccgttgattgatgaaggtccagatcccaatagcaagtggggtttaatctttgatggtgctgtcaatgcttatggtaaaggaattggggcagtcattgtatccccgcaggggcatcacattccttttaccgcccgaattttgttcgaatgtaccaacaatatggctgagtatgaagcatgtatctttgggatcgaggaagcaattgacatgagaatcaaacacctcgacatctatggagattctgcgctcgtcatcaatcagataaagggtgaatgggagacccaccatgctaagttgattccttatcgtgattatgcgagacgtttgctgacatattttacaaaggttgagctgcaccatattcctcgtgatgagaaccaaatggctgatgctcttgctactctatcctccatgtttcgagtaaaccattggaatgatgtgccaataatcaaagtgcaacgccttgaaagaccttcgcatgtgtttgctattggggatgtgatcgatcaggctggtgaaaatgtggttggctataaaccctggtactacgacatcaaacagttcttgctgagccgtgagtatccgccgggtgcttccaaacaagacaagaagaccttgagaagattggccagtagattcctgttagatggagatattctgtacaagagaaactatgacatggtattgttaagatgtgttgatgaacatgaagcggagcagttaatgcatgatgtacatgacggtaccttcgggacccatgctacagggcatactatgtcaaggaagttgttacgagcaggttactactggatggccatggagcatgattgctaccagcacgccagaaagtgccacaaatgtcaaatctatgctgataagattcatgtgcctccgcacgctctcaatgttatttcatccccatggccgttctcaatgtggggcatcgacatgattggaagaattgaaccgaaggcttcaaatggtcatcgtttcatcttagtggcaattgactacttcaccaaaaaagaatgtgacattccgtttatgttgaaagactctgattatttatgcgaaatttttatgttgggaaaacggggtgttacatcttataccaatgtgaccaagcaagtggtagctaagttcatcaagaacaacatcatctgtcgatatggtgttcccagcaagattattaccgacaatggtaccaacctgaacaacaatgtggtgcaagctctttgtgaagaattcaaaattgagcatcataactcttctccttatagacctcagatgaatggtgcagttgaggccgccaacaagaatatcaagagaaatgtccagaagatggtaaccacttacaaggactggcatgagatgttaccctatgctctgcatggctaccgtactaccgtgcgcagttcaaccggggcaacccctttctctcttgtatatggtatggaagcagttcttcctttggaagtggagatcccatcccttcgtgtgatcatggaagcaaagttatctgaggctgaatggtgccagagccggtatgatcagttgaatttgattgaggaaaaacgtatggatgccatggctcgtggacagtcatatcaagcaagaatgaagactgcttttgacaagaaagtccatcctcgagaattcaaggtaggggaacttgtattgaaaaggagggtaagccagcaacccgacccaaggggcaagtggacgcctaactatgaaggtccttatgttgtcaagaaggccttctccggtggtgctttaatccttacacacatggatggtgtagaacttccaaatccagtgaatgccgatatagtcaagaaatactttgcctag

SEQ ID NO: 643 - DNA, 6630 bp, Medicago sativa
atggaagaagagaacacgcagctccgtaccgaattggcatctctaagggaggaattggccaaagctcatgatgctatgactgctctgttggctgctcaagaacaaccaactcctgtagtttctgcagctgcaaatgtgactcctaccgtaacaactgatccccgctttatcatgccatctgggtatccttacggacttccgccgtactatactgctaatacaggggcaggcacctctggtactaccaacaatggcccaatttcaggggcaaacttgactcctgttagtaccgccttgactcaagccgcaacaactgttaccgagcccattgtgaatacggtgcctcaatttgtccatgttaatgcgcaccacgggagtattgccgcaaccgaaactatggaagagagaatggaagaacttgccaaagagctccgacgggaaattaaggccaacaggggaaacggagactccattaaaacccaggatctctgcttagtatcgaaggtagatgttccaaaaaagttcaaagtcccggagttcgacaagtataacgggctgacttgtcctcaaaatcatattgtcaaatatgtccggaaaatgggcaactacaaggacaatgattcccttatgatccattacttccaaggcagtctgatggaggatgctgcagagtggtatactagtctgagcaaagatgatgtccacacttttgatgagctagcagccgctttcaaaagccattatgggttcaacacaagattgaagccaaatagggagtttctcaggtccctgtctcagaagaaggaggaaagtttccgtgaatatgcgcaaaggtggagaggggcagctgcccgtatcactcctgctttagatgaagaagaaatgactcagacatttctgaagactctcaagagagattatgttgaaaggatgattatcgcagcaccaaacaatttctcagagatggttaccatgggaacacgtctggaagaagctgttcgggaaggcatcattgtgtttgagaagattgagtcatctgcaaatgctgcgaagagatacggtaatggacatcacaagaagaaagatacggaggtgggaatgatagccgctggaactaatccatccaaggctactgttgctcctgtcaatgctgctcagtttcccccgtcctacccttatgcaccgtactctcagcatccgttcttcccaccgttttatcatcagtaccctttgccaccgggccaacctcaggtccctgtcaatgccatcgctcaacaggtgcaacatcaaccgccagttcaacagcagcagcagcaatatgctagaccaacttttcctcctataccaatgttgtatgcagaacttcttccaactttactccagagaggacactgcacgactaggcagggcaagcctccaccggaccctttacctccaaggttccgctctgatcttaagtgtgacttccatcaaggcgctttagggcatgatgttgaggggtgctatgctctaaagtacatcgtcaagaagcttatagatcaagggaagttaacttttgagaacaatgtgccacatgtcctcgataatccgctcccaaatcatgctgccgtgaatatgattgagatatgtgaagaggttcccatgctggatgtccgcaatgttgcaactcctctggtgccactccatatcaagttgtgccaggctttattgtttgaacatgatcatgctgagtgccaagaatgttcccgcaatcctttgggttgccatgtcgtccaaaacgatgtccagagcttgatggacggcaattaccttactgtcagtgatgtttgcgtaattgtgccggtctttcacgatccgcctgttaagagggtgcctttgagggagagcgttgagccgttggtgataaggttgccaggaccaattccttatgtttcggacaaggctgttccatacaaatacaatgctactatgatagaaaatggagtagaggtgcctctagcctcctttgccacagtaagcaatattgccgaagggacttctgcagcgctaagaagcgggaaggtccgtccgccgttatttcagaagaaggtagctacgccaaccactccaccagttgaagaagcaactccaaccgttgtttcacccattgctatagatgtgaaccagccaggcaaatctatagaggattcgaatttagatgagattctgaggataataaagaggagcgactacaagatcgttgatcaattgctgcaaactccttcaaagatatatgtcttgtcgttactcttgagctctgaggctcacaggaataccttgttgaaagtgttggagcaggcttatgttgaccacgaggtcacgagtcacaatctggctttgcacatctcggtgaattgcaaatcagacatgatatcaaatgtgttagtggataccggttcctccctcaatgtaatgcccaagtcaactctagatcagttgagctaccgagggacccctttgaggaggagtactttcttggtcaaagcttttgacggatctcgaaagaatgtgctgggggagatagacttaccgataaccattggccctgagaatttcttgattaccttccaagtgatggacattaatgcatcctacagttgtctgctgggaagaccgtggatacacgatgcgggtgtggtaacctccaccttacatcagaagttgaagttcataagaagtggaaagcttgttaccattcatggagaagaggcatacctggttagccagctatcatctttctcttgcatagaggcagggtcggcagaggggaccgcttttcaaggattaactgtcgaaggtacggagcccaagagggatggaactgccatggcttctttgaaggatgcacagagagccgtccaagagggtcaagctgccggctggggcaagttaatacagcttcgtgagaacaagcataaggaaggtcttggcttttccccaacttcaggagtttccaccggggcattctgtagtgctgggtttgtcaacgcaatcacagaagaagcaactggatttggcccgaggcctgtatttgttacaccaggaggctttgcgagagattgggatgccattgacattccctcaatcatgcatgtttctgaattgaactataataaacccgttgggcacagtaaccctgcattccctccgaatttcgagttcccagtgtatgaggccgaagatgaggaaggtgatgacgtaccatatgagatcactcggttacttgagcaagaaaagaaagccattcagcctcaccaggaagagattgagcttatcaacataggtaccgaggagaacaagcgagaaatcaagatcggtgctgctctagaggaatgggttaaaaagaagatcatccaactcctccgggaatatccggacatttttgcatggtcgtatgaagatatgccaggtctagatcctatgattgtggagcatcggattcccaccaagcctgaatgtcctcccgtcaggcagaaattgagaaggactcatccagacatggctctcaagattaagagcgaggttcaaaaacagattgatgcgggtttcctcatgacagttgagtaccctgaatgggttgccaatattgtacctgtgccaaagaaggatggtaaagtccggatgtgtgttgacttcagagacctgaacaaagccagtccaaaagacaactttccattacctcatattgatgtgcttgttgataatactgctcagtctaaggtgttttccttcatggacggtttctccggttacaatcagatcaaaatgtctcctgaagatagagaaaagacgtcttttatcactccatggggtactttctgctacaaagtgatgccgttcggcctaataaatgctggtgctacctaccaaagaggaatgactactctgtttcatgacatgattcacaaagaagtcgaagtatatgtggatgatatgattgtaaagtcaacagatgaggagcaacatgttgagtatttgacaaagatgtttgaaaggttaagaaaatacaagcttcgattgaatcccaacaaatgtatattcggcgtcagatccgggaagttattaggcttcattgtcagccaaaagggcattgaagtcgatcctgataaagtccgggccatccgagaaatgccagctccacggatcgagaagcaagtcagaggtttcctcggacgtttgaattacatctcccgattcatatctcacatgaccgcaacctgcgggccgatcttcaagctactcagaaagaatcagtctgttgtatggaatgatgaatgccaagaagcttttgatagcatcaagaattacctgctggaaccacctatccttgtcccgcccgtggaaggaaggcctttgattatgtatttggcagtatttgatgaatccatgggatgcgtacttggtcaacaagatgagactggaaagaaagaacatgctatctactatctaagcaagaagttcaccgattgtgaaactcggtatacaatgcttgagaagacttgttgtgctttggcctgggccgctaaacgcctgcgtcattatttggtgaatcatacaacttggttgatatccagaatggatccgataaagtatatctttgagaaagctgctgttactgggaagattgcacgatggcagatgcttttgtctgaatatgatattgtgttcaaaactcaaaaggcaatcaaaggtagcattcttgccgatcaccttgcttaccaacctcttgacgattatcaaccaattgaattcgacttccccgatgaagaaatcatgtatttgaaatcaaaagactgcgaagaaccgttgattaatgaaggtccagatcccaatagcaagtggggtttagtctttgatggtgctgtcaatgcttatggtaaaggaattggggcagtcattgtatccccacaggggcatcacatcccttttaccgccagaattctgttcgaatgtacaaacaatatggctgagtatgaagcatgtatctttgggatcgaggaagcaattgacatgagaatcaaacacctcgacatctatggagattctgcgctcgtcatcaatcagataaagggtgaatgggagacccaccatgctaagttgattccttatcgtgattatgcgagacgtctgctgacatattttacaaaggttgagctgcaccatattcctcgtgatgagaaccaaatggctgatgctcttgctactctatcctccatgtttcgagtaaaccattggaatgatgtgccaataatcaaagtgcaacaccttgaaagaccttcacatgtgtttgctattggggatgtgatcgatcaggctggtgaaaatgtggttgactataaaccctggtactacgacatcaaacagttcttgctgagccgtgagtatccgccgggtgcttccaaacaagataagaagaccctgagaagattggccagtagattcctgttagatggagatattctgtacaagagaaactatgacatggtattgttaagatgtgttgatgaacacgaagcagagcagttaatgcatgatgtacatgacggtacctttgggacccatgctacagggcatactatgtcaaggaagttgttacgggcaggttactactggatggccatggagcatgattgctaccagcacgccagaaagtgccacaaatgtcaaatctatgctgataagattcatgtgcctccgcacgctctcaatgttatttcatccccatggccgttctcaatgtggggcatcgacatgattggaagaattgaaccgaaggcttcaaatggtcatcgtttcatcttagtggcaattgactacttcaccaagtgggttgaagcagcatcttataccaatgtgaccaagcaagtggtagctaagttcatcaagaacaacatcatctgtcgatatggtgttcccagcaagattattaccgacaatggtaccaacctgaataacaatgtggtgcaagctctttgtgaagaattcaaaattgagcatcataactcttctccttatagacctcagatgaatggtgcagttgaggccgccaacaagaatatcaagagaattgtccagaagatggtaaccacttacaaggactggcatgagatgttaccctatgctctgcatggctaccgtaccactgtgcgcagttcaaccggggcaacccctttctctcttgtatatggtatggaagcagttcttcctttggaagtggagatcccatccctccgtgtgatcatggaagcaaagttatctgaggctgaatggtgccaaacccggtatgatcagttgaatttgattgaggaaaaacgtatggatgccatggctcgtggacagtcatatcaagcaagaatgaagaccgcttttgacaagaaagtccgtcctcgagaattcaaggtaggggaacttgtattgaaaaggagggtaagccagcaacccgacccaaggggcaagtggacgcctaactatgaaggtccttatgttgtcaagaaggccttctccgatggtgctttaatccttacacacatggatggtgtagaacttccaaatccagtgaatgccgatatagtcaagaaatactttgcctag

SEQ ID NO: 644 - DNA, 6222 bp, Medicago sativa
atgaagaaggtagatgttccaaaaaagttcaaagtcccggagttcgacaagtataacgggctgacttgtcctcaaaatcatattgtcaaatatgtccggaagatgggcaactacaaggacaatgattcccttatgatccattacttccaagacagtctgatggaagatgctgcagagtggtatactagtctgagcaaagatgatgtccacacttttgatgagctagcaaccgctttcaaaagccattatgggttcaatacaagactgaagccaaatagggagtttctcaggtccctatctcagaagaaggaggaaagtttccgtgaatatgcgcaaaggtggagaggggcagctgcccgtatcactcctgctttagatgaagaggaaatgactcagacatttctgaagactctcaagagggattatgttgaaaggatgattatcgcagccccaaacaatttctcagagatggttaccatgggaacacgtctggaagaagctgttcgggaaggcatcatcgtgtttgagaagattgagtcatctgcgaatgctgtgaagagatatggtaatggacatcacaagaagaaagatacggaggtgggaatgatagccgctggaactaatccatccaaggctactgttgctcctgtcaatgctgctcagtttcccccgtcctacccttatgcaccgtactctcagcatccgttcttcccaccgttttatcatcagtaccctttgccaccgggccaacctcaggtccctgtcaatgccatcgctcaacaggtgcaacatcaaccgccagttcaacagcagcagcagcaatatgctagaccaacttttcctcctataccaatgttgtatgcagagcttcttccaactttactccagagaggacactgcacgactaggcagggcaagcctccaccggaccctttacctccaaggttccgctctgatcttaagtgtgacttccatcaaggcgctttagggcatgatgttgaggggtgctatgctctaaagtacatcgtcaagaagcttatagatcaagggaagttaacttttgagaacaatgtgccacatgtcctcgataatccgctcccaaatcatgctgccgtgaatatgattgagatatgtgaagaggttcccatgctggatgtccgcaatgttgcaactcctctggtgccactccatatcaagttgtgccaagctttattgtttgaacatgatcatgctaagtgccaagaatgttcccgcaatcctttgggctgccatgtcgtccaaaacgatgtccagagcttgatggacggcaattaccttactgtcagtgatgtttgcgtaattgtgccggtctttcacgatccacctgttaagagggtgcctttgagggagagcgttgagccgttggtgataaggttgtcaggaccaattccttatgtttcggacaaggctgttccatacaaatacaatgctactatgatagaaaatggagtagaggtgcctctagcctcctttgccacagtaagcaatattgccgaagggacttctgcagcgctaagaagcgggagagtccgtctgccgttatttcaaaagaaggcagctacgcctaccgtgccacccattgacaagccaaccccgactgatgtttctcccgttaacagagacgcgagccaaccaagccggtctatagaggattctaatctggacgagattttgaggttgatcaaaagaagtgattataagattgtagatcaactgctgcaaactccgtcgaagatatccattttgtctctactcctgagttccgctgcccacagagatacccttttgaaagtattggagcaggcttatgtggatcatgaagtaactgtggatcactttggtagtatagtgggaaacattaccgcctgcagcaatctgtggttcagtgaagatgaattgcccgaagcaggaaagcatcataacctggccttgcatatctccgtaaattgcaagtccgacatgatctcaaatgtgctagtagacactggctcatctttgaacgtgatgcccaagtcaacgctggatcagctgagttaccgaggaactcccttgaggaggagcacttttctggtcaaagcctttgatggaacccgcaagagtgttctcggggagatagacttgccaataactatcggccccgaaacctttctaatcacctttcaggtcatggatattaatgcctcttacagttgtctgctgggaagaccgtggatacacgacgcgggagcagtgacctctactttgcaccaaaagttgaaatttgcaaaaagtggaaagcttgttaccattcatggagaggaggcatacctggttagccagctatcatctttctcttgcatagaggcagggtctgtagaggggaccgcttttcaaggattaactgtcgaaggtacggagcccaaaagggatggaactgcaatggcttctttgaaggatgcacagagagccgtccaagagggtcaagctgccggctggggcaggttaatacagcttcgtgagaacaagcataaggaaggtcttggcttctccccaacttcaggagtttccaccggggcattctgtagtgctgggtttgtcaacgcaatcacagaagaagcaactggatttggcccgaggcctgtatttgttacactaggaggcattgcgagagattgggatgccattgacattccctcaatcatgcatgtttctgaattgaactataatgaacccgttgggcacagtaatcctgcattctctccgaattttgagtttccagtgtatgaagccgaagatgaggaaggtgatgacataccatatgagatcactcggttacttgagcaagaaaagaaaaccattcagcctcaccaggaagagattgagcttatcaacataggtaccgaggagaacaagcgagaaatcaagatcggtgctgctctaggggaaggggctaaaaagaggatcatccaactcctccgggaatatccagatatttttgcatggtcgtatgaagatacgccaggtctagatcctatgattgtggagcatcggatccccaccaagcctgaatgtcctcccgtcaggcaaaaattgagaaggactcatccagatatggctctcaagattaagagcgaggttcaaaaacagattgatgcgggtttcctcatgacagttgagtaccctgaatgggttgccaatattgtacctgtgccaaagaaggatggtaaagtccggatgtgtgttgacttcagagacctgaacaaagccagtccaaaagacaactttccattacctcatattgatgtgcttgttgataatactgctcagtctaaggtgttctccttcatggatggtttctccggttacaatcagatcaaaatgtctccggaggatagagaaaagacgtcttttatcactccatggggtactttctgctacaaagtgatgccattcggcttaataaatgctggtgctacctaccaaagaggaatgactactctgtttcatgacatgattcacaaagaagtcgaagtatatgtggatgatatgattgtaaagtcaacagatgaggagcaacatgttgaatatttgacaaagatgtttgaaaggttaagaaaatacaagcttcgattgaatcccaacaaatgtacattcggcgtcagatccgggaagttattaggcttcattgtcagccaaaagggcattgaagtcgatcctgataaagtccgggccatccgagaaatgccagctccacagaccgagaagcaagtcagaggtttcctcggacgtttgaattacatctcccgattcatatctcacatgaccgcaacctgcgggccgatcttcaagctactcagaaagaatcagcctgtcgtatggaatgatgaatgccaagaagcttttgatagcatcaagaattacctgctggaaccccctatccttgtcccacccgtggaaggaaggcctttgattatgtatttggcagtatttgatgaatccatgggatgcgtacttggtcaacaagatgagactggaaagaaagaacatgctatctactatctaagcaagaagttcaccgattgtgaaactcggtatacaatgcttgagaagacttgttgtgctttggcctgggccgctaaacgcctgcgtcattatttggtgaatcatacaacttggttgatatccagaatggatccgataaagtatatctttgagaaagctgttgttactgggaagattgcacgctggcagatgcttttgtctgaatatgatattgtgttcaaaactcaaaaggcaatcaaaggtagcattcttgccgatcatcttgcctaccaacctcttgatgattaccaaccaattgagtttgatttccccgatgaagagatcatgtatttgaaatcaaaagactgcgaagaaccgttgattggtgaaggtccagatcccaatagcaagtggggtttagtctttgatggtgctgtcaatgcttatggtaaaggaattggggcagtcattgtatccccgcagggacatcacattccttttaccgcccgaattctgttcgaatgtacaaacaatatggccgagtatgaagcatgtatctttgggatcgaggaagcaattgacatgagaatcaaacacctcgacatctatggagattctgcgctcgtcatcaatcagataaagggtgaatgggagacccaccatgctaagttgattccttatcgggattatgcgagacgtttgctgacatattttacaaaggttgagttgcaccatattcctcgtgatgagaaccaaatggctgatgctcttgctactctatcctccatgtttcgagtaaaccattggaatgatgtgccaataatcaaagtgcaacgccttgaaagaccttcacatgtgtttgctattggggatgtgatcgatcaggctggcgaaaatgtggttaactataaaccctggtactacgacatcaaacagttcttgctgagccgtgagtatccgtcgggtgcttccaaacaagacaagaggactttgagaagattggccagtagattcctgttagatggggatattctgtacaagagaaactatgacatggtattgttaagatgtgttgatgaacatgaagcagagcagttaatgcatgatgtacatgacggtaccttcgggacccatgctacagggcatactatgtcaaggaagttgttacgagcaggttactactggatggccatggagcatgattgctaccagtacgccagaaagtgccataaatgtcaaatctatgctgataagattcatgtgcctccgcacgctctcaatgttatttcatccccatggccgttctcaatgtggggcatcgacatgattggaagaattgaaccgaaggcttcaaatggtcatcgtttcatcttagtggcaattgactacttcaccaagtgggttgaagcagcatcttataccaatgtgaccaagcaagtggtagctaagtttatcaagaacaacatcatatgtcgatatggtgttcccagcaagattattaccgacaatggtaccaacctgaacaacaatgtggtgcaagctctttgtgaagaattcaaaattgagcatcataactcttctccttatagacctcagatgaatggtgcagttgaggccgccaacaagaatatcaagagaattgtccagaagatggtaaccacttacaaggactggcatgagatgttaccctatgctctgcatggctaccgtactactgtgcgcagttcaaccggggcaacccctttctctcttgtatatggtatggaagcagttcttcctttggaagtagagatcccatctctccgtgtgatcatggaagcaaagttatctgaggctgaatggtgccaaagccggtatgatcagttgaatttgattgaggaaaaacgtatggatgccatggctcgtggacattcatatcaagcaagaatgaagactgcctttgacaagaaagttcatcctcgagaattcaaggtaggggaacttgtattgaaaagaaggataagccagcaacccgacccaaggggcaagtggacgcctaactatgaaggtccttatgttgtcaagaaggccttctccggtggtgctttaatccttacacacatggatggtgtagaacttccaaatccagtgaatgctgatatagtcaagaaatactttgcctag

SEQ ID NO: 645 - DNA, 4575 bp, Medicago sativa
atgggaacacgtctggaagaagctgttcgggaaggcatcatcgtgtttgagaagattgagtcatctgcgaatgctgtgaagagatatggtaatggacatcacaagaagaaagatacggaggtgggaatgatagccgctggaactaatccatccatggctactgttgctcctatcaatgctgctcagtttcccccgtcctacccttatgcaccgtactctcagcatccgttcttcccaccgttttatcatcagtaccctttgccaccgggccaacctcaggtccctgtcaatgccatcgctcaacaggtgcaacatcaaccgccagttcaacagcagcagcagcaatatgctagaccaacttttcctcctataccaatgttgtatgcagagcttcttccaactttactccagagaggacactgcacgactaggcagggcaagcctccaccggaccctttacctccaaggttccgctctgatcttaagtgtgacttccatcaaggcgctttagggcatgatgttaaggggtgctatgctctaaagtacatcgtcaagaagcttatagatcaagggaagttaacttttgagaacaatgtgccacatgtcctcgataatccgctcccaaatgatgctgccgtgaatataattgagatatgtgaagaggttcccatgctggatgtccgcaatgttgcaactcctctggtgccgctccatatcaagttgtgccaagctttattgtttgaacatgatcatgctgagtgccaagaatgttcccgcaatcctttgggctgccatgtcgtccaaaacgatgtccagagcttgatggacggcaattaccttactgtcagtgatgtttgcgtaattgtgccggtctttcacgatccacctgttaagagggtgcctttgagggagagcgttgagccgttggtgataaggttgccaggaccaattccttatgtttcggacaaggctgttccatacaaatacaatgctactatgatagcaaatggagtagaggtgcctctagcctcctttgccacagtaagcaatattgccgaagggacttctgcagcgctaagaagcgggaaggtccgtccgccgttatttcagaagaaggtagctacgccaaccactccaccagttgaagaagcaactccaaccgttgtttcacccattgctacagatgtgaaccagccaggcaaatctatagaggattcgaatttagatgagattctgaggataataaagaggagcgactacaagatcgttgatcaattgctgcaaactccttcaaagatatctgtcttgtcgttactcttgatctctgaggctcacaggaataccttgttgaaagtgctggagcaggcttatgttgaccacgaagtcacggtagatcgtttcgatggcatagtgggaaatattactgcttgtaacaacctctggtttagtgaagaagagttgccgaaagtgggaaagagtcacaatctggctttgcacatctcggtgaattgcaaatcagacatgatatcaaatgtgttggtggataccggttcctccctcaatgtaatgcccaagtcaactctagaccagttgagctaccgagggacccctttgaggaggagtactttcttggtcaaagcttttgacggatctcgaaagagtgttctcggggagatagacttgccaataactatcggccccgaaacctttctaatcacctttcaggtcatggatattaatgcctcttacagctgtctcctggggagaccatggatacacgacgcgggagcagtgacctctactttgcaccaaaagttgaaatttgcaaaaagtggaaagcttgttaccattcatggagaggaagcatacctgattagccagctatcatctttctcttgcatagtagcagggtctgcagaggggaccgcttttcaaggattgactgtcgaaggtacggagcccaagagggatggaactgcaatggcttctttgaaggatgcacagagagccatccaagagggccaagctgccggctggggcaggttaatacagcttcgtgagaacaagcataaggaaggtcttggcttttccccgactttaggagtttccgccggggcattctatagtgctgggtttgtcaacgcaatcacagaagaagcaactggatttggcccgaggcctgcatttgttacaccaggaggctttgcgagagattgggatgccattgacattccctcaatcatgcatgtttctgataaccctgcatttcctccaaattttgaattccctgtgcatgatgccgaaaatgaagaggatgatgatataccatatgagatcactcgactgcttgaacaagagggaagagccattcagcctcaccaggaagagatcgagatcatcaacttcggtataccgactgctatctactatctaagcaagaagttcaccgattgtgaaactcggtatacaatgcttgagaagacttgttgtgctctggcctgggccgctaaacgcctgcgtcattatttggtgaatcatacaacttggttgatatccagaatggatccgataaagtatatctttgagaaagctgttgttactgggaagattgcacgctggcaggtgctcttgtctgaatatgatattgtgttcaaaactcaaaaggcaatcaaaggtagcattcttgccgatcaccttgcttaccaacctcttgatgattaccaaccaattgaattcgatttccccgatgaagagatcatgtatttaaaatcaaaagactgcgaagaaccgttgattgatgaaggtccagatcccaatagcaagtggggtttagtctttgatggtgctgtcaatgcttatggtaaaggaattggggcagtcattgtatccccacaggggcatcacatcccttttaccgccagaattctgttcgaatgtacaaacaatatggctgagtatgaagcatgtatctttgggatcgaggaagcaattgacatgagaatcaaacacctcgacatctatggagattctgcgctcgtcatcaatcagataaagggtgaatgggagacccatcatgctaagttgattccttatcgtgattatgcgagacgtttgctgacatattttacaaaggttgagctgcaccatattcctcgtgatgagaaccaaatggctgacgctcttgctactctatcttccatgtttcgagtaaaccattggaatgatgtgccaataatcaaagtgcaacgccttgaaagaccttcacatgtgtttgctattggggatgtgatcgatcaggctggcgaaaatgtggttgactataaaccctggtactacgacatcaaacagttcttgctgagccgtgagtatccgccgggtgcttccaaacaagataagaagaccctgagaagattgaccagtagattcctgttagatggagatattctgtacaagagaaactatgacatggtattgttaagatgtgttgatgaacatgaagcagagcagttaatgcatgatgtacatgacggtaccttcaggacccatgctacagggcatactatgtcaaggaagttgttacgggcaggttactactggatggccatggagcatgattgctaccagcacgccagaaagtgccacaaatgtcaaatctatgctgataagattcatgtgcctccgcacgctctcaatgttatttcatccccatggccgttctcaatgtggggcatcgacatgattggaagaattgaaccgaaggcttcaaatggtcatcatttcatcttagtggcaattgactacttcaccaagtgggttgaagcagcatcttataccaatgtgaccaagcaagtggtagctaagttcatcaagaacaacatcatatgtcgatatggtgttcccagcaagattattaccgacaatggtacaaacctgaataacaatgtggtgcaagctctttgtgaagaattcaaaattgagcatcataactcttctccctatagacctcagatgaatggtgcagttgaggccaccaacaagaatatcaagagaattgtccagaagatggtaaccacttacaaggactggcatgagatgttaccctatgctctgcatggctaccgtactaccgtgcgcagttcaaccggggcaacccctttctctcttgtatatggtatggaagcagttcttcctttggaagtggagatcccatctctccgtgtgatcatggaagcaaagttatccgaggctgaatggtgccaaagccggtatgatcagttgaatttgattgaggaaaaacgtatggatgccgtggctcgtggacagtcatatcaagcaagaatgaagactgcctttgacaagaaagtccatcctcgagaattcaaggtaggggaacttgtattgaaaagaaggataagccagcaacccgacccaaggggcaagtggacgcctaactatgaaggtccttatgttgtcaagaaggccttctccggtggtgctttaatccttacacacatggatggtgtagaacttccaaatccagtgaatgccgatatagtcaagaaatactttgcctag

SEQ ID NO: 646 - DNA, 1693 bp, Medicago sativa
ggtactttcacaagctactaatatagggtcttaaattcacaacatgcacacaaaaacaaattattcaaacacatataacagcttctcacagaactgttatttattgacagaactaaaaagaggtcattcagcatttccagcaagaaactgcaacaataggctttgatttccatccaagaaccaaacaccctttctcttccacaacagtatatccatcacaaacattattcttcacaagccactgcttagcttgaaccaccatcttaataggtgaaccttgaaatccagccctactcattctcctcctccactgatcaactttctcatgcctctccatcctcaatggtccttcacagctcacaatgttctttatctcctcagcaaaataaaactgttccatttttgccctcttagtgtcatactttggcagcatagcatccaatgagtcaaaaatagcagaataataatgcaatgattccataaaccttccaaggaaaaaaggtccattatgaccagaatcttgctcagccataaccaacactttcggtgaaagaccgtgtatcatttgtaaaaccgcattcaaagcgccacgactctctttaacaacacaatgcaattgaagaatgctgttaaccacaaggacctctttttcattcacttttatgtccttaggtttcaaattctccaaattcttctcaacaattgagaattccaaatgaatccccaagtttttcgcgtaaattgagagttcttcaccaatgacttggattctagcaatgcatagaccaatcgctgtgatcctaagcctccgaacacggtggctggatcgatccgcgagactttgaattagtcctcgccattggtgtccatgtggaagaccaaggctcatgccaagatcaaccacatgaagaaaactctcaccctcaaaggcttccaatattatggaattagccacaaaatgtccaaattgaatatgtggacaattttcataaaccaacttgaatgcttcttccatttcttctgatgcagcatccattatgttcatcattgattttgtatctgatccagcagagttattaccaattggttgaatcagagttagtctctctgtgagtccttgaacaaaacaagaagcaactctttgaaacgaagaaccaaacaccaaagcatttgatttaagctcagatagtaaaaccgaagcgtgtgatttatcgcgacacgcgacagcttcagcacatgcaattagaagttgaactagtctcattccatcagcacatgaaccatcttcttcagcttcgcaattattgtagttgaagttatcttctgctgcttcttcaacagcttcagaagcaaaatatctttgtttataagttcttatgtgatctctgaaatgaagccttggaatgctattcacactgttgttattgctgttgatgttattgaagaaactattactatggctgctgaaattagcaaaccaaatagggatagttacggttgatcttttcaatttcttgtgatccctaatggtttcagtttcatgatcagaaaatggattaaggatccatgttgaagtagcactgttttctaaaataggcaaatttggatataaagaagcatagtaagaacccattaatgatggattttcatctacctcacatttgaaggtactagcataaagtgcaggtgacat

SEQ ID NO: 647 - DNA, 3561 bp, Medicago sativa
atggcagctattgtgggagaaaaaatgatctcaaattctgtagaggtgttgttagaaaagcttgtttctggtgagttcgtggatgattttcggagcacaaagcttgacgattcactcttgacaaagctgaagaaaacactgatgactattgaatatgtactttatattgacgagaataaagggttcaccacttgttcaaaaaagaaaaaagggctcaccactttatttattgaggggaaagggatcatcacccgttcaaaaaaaataaataaagagatcaccaatcctactttcaaccaacggttggatatgctgagatgtgttgtcttagaagttgaaaataaagggatcaaagagctaggtgaatcttctgcacgttctgctcgggtagatgaatcttctatttatggaagagatgatgatagaaagaaacttaaacatcttttattatctactggttttgataatagtaaagtaggaattatttccattgtgggtatgggagggattggtaaaacatcccttgctaaactgctttactatgatcccgaagtaagagaaaaatttgagttaaaactgtgggcaaatatctcaaatgcttttgaacatgttaatgattttagtgtttttgaaaccattcttgaatctattgcttcaaaaaaaatcagcgatgataacttgaatagacaaaaaactgacacaagtgatgcgaaaatcatttacccaaaagttttgctcgtactggacgacgcgagggatgcagaaattgtcaatcgaatatatcagatggatatctttattgctggggaaatgggaagtaggatcattgttacaactcggaatgaaaaagttgctatgtccatgaaatactctctttatgttcactatttgagacctctcgaaagtgaagattgctggtctttaattgccagacatgcatttggaccatgtaactaccaagaaagaaccaatctagaagaaattggcagggaaattgcaaaaaaatgtggtggattgccatatattgcactagcacttgggactcttcttcgcagcaaaatttccccagattactggaattatgtgctagaaactaacatttgggaattgacagattctgaggtgcaagaggctttacgattgagcttacattatctgttgcttcctctaaaagaatgctttgcatattgttcaaattttccaaagaattccatcttagaaaagaagacgataattcagttgtggattgcagaaggtttagtagaatcgtccacaagtcaggagtgttgggaaaaagttggagaagaatactttgatctactagtgtcgaggttgttgatacaactacgatctatcgatgatgaggaagcaaactttgaaattaataacttcatgcatgacttaggtacaacggtttcatcacaatatgacttgtggactctaaaacataatttctcttacactagaggggattatgactcattaaataaatttgataaattgcatgaattaaaaggtctacgtacctttctagcattaccatttcaagaacaatctcctctttgtctactatcgaacaaggtcatacatgcaatgctgccaaggatgaagaagttacgggtgttatctttgtcaaactacagaagtatcactgaggttcccaactctattggaagtttgatatacctgcggtacctaaatctttctcacacacagattgaaaggttgccttctaaaacatgcaagctttacaatctacagttcttgttgttgtcaggctgtaaaaggctcactgaattgccggaagacatgggaaaattagttaatctactccaccttaacattagtgacactgcattgagggagatgcccgaacaaatagccaaactacaaaatctccaaagtttgtctgactttgttgtcagcagtggattgaagattgcagagctaggaaaatttccccaactacatggaaaacttgcaatctcacagctacaaaatgttaatgacccattggaagcttctctagctaatatgatgatgaaagaaagaatagacgagttagctttagaatgggattgtggtagtaatttttcagattcaaaaatacaaagtgttgtacttgaaaatttgcgaccctcgacaaatttgaaaagtctcaccatcaaaggctatggtggaatcagctttccaaattggttgggtgatattttatttagcaacatgatgtctttaaggatctcgaattgtgatgcttgtttatggcttcctccccttggacagttgggtaatctaaaagagctcattattaaagggatgcaatcaatacagacaattggtactgagttctatggaagtgatcggtcttcatttcaaccattcccctccttggtgactctacactttgaggatatggaagagtgggaggaatgggacttgaatggaggtacaacaacaaagtttcctagtttaaaaactttattattgagtaagtgcccaaaacttagcgtaggaaacatgcctaacaaatttccttccttaactgaacttgagttgagagaatgtcctctactggtgcaatcaatgccatcattagatcgtgtattcaggcaactgatgttcccttcgaatcatcttcgacagctaaccatagatggcttttcatctccgatgtctttcccaacagacggtctacagaaaaccttgaaatttctgataatcagtaattgtgagaatctagagttccctcctcatgactacttgcgcaatcacaattttacatctcttgaggaattaacaatatcttatagctgtaattcaatggtatcatttaccttgggcgctctccctgtcctcaagagtttgttcattgagggttgtaaaaatctgaaatcgatattaattgcagaagacgactcccaaaatagtctctcatttcttagaagcatcaaaatatgggactgtaacgagctgaagtcatttcccacaggtggattgcccactccaaacctcatttatattgcagtgtggcagtgtgagaagcttcattcactgccagaaccaatgaacactctaaccaaccttcaagaaatggaaattgataatctaccaaatcttcaatctttaatcatagatgatttgcctgtcagtttacaggaacttactgttggctctgttggagtgattatgtggaatacggagccaacttgggaacatctgacttgtctttcagtgttgcgaattaatggtgctgatacggtgaagacactgatggggccatctctacctgcatcgcttctgacactatgcatctgtggtcttactgatacacgcattgatgggaagtggcttcaacatctcgtctctctccaaaaacttgagattattaatgctcccaaactcaagatgtttcctaaaaaaggatttccttcctctctttcagtgctaagtatgactcggtgtccattactagaagcaagtgtgcgcaggaagcgagggaaagagtggcgtaagattgctcatattccctccatagttatcgatgatgaacttatcacctga

SEQ ID NO: 648 - DNA, 646 bp, Medicago sativa
  misc_feature (595)..(595): n is a, c, g, or t
ggccgaggggcagaagcagtgattggtggagctttcctctctgctttctttgatgttgtcttcaaaaggctggcatcacctgaagttgctaatttgatccttggaaacaaacttgacaagaaattgcttcagaggctcgagacaactttgagagtggttagagctgtgcttaatgatgctgagaagaaacaaaccagggattctgatgtcaacaactggctcaatgatctcaaagatgctgtctatgtagctgatgacttattggatgaagtttcgacaaaaactgtgattcaaaaagaggtaactaatctcttttcgcgctttttcaatgtgcaagataggggtatggttagtaagtttgaagatatagttgagagactagaatatattttgaaactcaaagacagtcttgaactcaaagagattgtagtggagaatttgtcatataaaactccatcaacatctctccaagacgaatctcgtgtgtatggcagggacaaagacaaggagggcatcatcaagtttttgttagatgataacagtgataatggtgaagaagtgattgtgatacctattgtgggaatgggaggggtangaaaaactactttagctcagttggtgtacaatgatgagtatttgaagcatg

SEQ ID NO: 649 - DNA, 3807 bp, Medicago sativa
atggctgcaactttggtggcaggtgcatttctctctgctactattcaaaccatagcagataagctaagctcatcggagtttcgcagtttcatcagaagcaccaagttcaattactcacaactgaaagagttgaaaacgacactgttttctcttcaagctgtgctggttgatgcagaacagaaacaattcaacgatcttcctgtcaaacaatggcttgatgatttgaaagacgctatctttgacacggaagatctgctcgatttaatcaactacgatgccttgaggtgcaaggtggagaaaacaccagttgatcagctgcagaatttaccttcatctataaagatcaatttgaagatggagaagatgtgtaaaaggttgcaaacttttgtccagcagaaagacatcctttgcttgcaaagaacggtaagtggtagagtttctcgtagaaccccttcaagttccgtggtaaatgaatctgtcatggtaggaaggaatgatgataaaaatagacttgtcagtatgctggtatcagacataggcaccagcataaataacaatttaggtgttgttgcaatattggggatgggaggtgtcggtaaaacgacccttgcacagcttgtttacaatgatgaaaaggttgaacatcattttgatctcaaagcctgggtttgtgtatcagaagattttgatgttgtgagagtaaccaagtctctccttgaatctgttgttagaaatacaacatttgctgcttcaaaggtctgggaaagcgataatcttgatatcctccgagttgaattaatgaaacaattgatggatagaagatttttgtttgtgttggacgacttatggaatgacaattacgttgattggagtgagctagtaactcccttgtttaagggaaaagctggaagcaaggtcatcataacaacacgcctaaaaaaagttgcggaggttgcacgcacatttccaattcataaattagaacctatatccgatgaagattgttggtctttgctctcaaagcatgcatttggaggtgaagaccttggtcacagtaaatactcaaatttagaagcaattggcaggaagatatctagaaagtgtgatggcttgccaatagctgccaaagcactcggtggactaatgcgctcgaaggtagatgaaaatgagtggactgcaattctgaatagcgatatatggcaattacaaaatgataaaattctcccggctttgcatttgagttatcaatatcttccgtctcatttgaaaatatgttttgcatattgttcaattttctcaaaggattactcatttgataggaagaaattggttttgttgtggatggcagaaggattcctcgactattctcaagggggaaaagcagcagaggaagtgggtgacgactgtttttctgaattgttatccagatccttaattcaacaaacaaatgatgattctcatgagaaaaagtttttcatgcacggccttgtctacgacttagctacagtcgtatctggaaaaagttgttgcaggtttgaatgtggtgacatctctgaaaatatccgtcatttgtcatacaatcaaggagagtatgatatcttcatgaagtttaagaatttatacaatttcaaacgcctgcgaagcttccttcctatttacttctcaacggcaggaaattacttatccatcaaggtggttgatgatttcctaccaaagctcaaaaggttgcgtgtgttatcgctatcaaattataaaaacatcaccaagctaccagattcagttgccaatttggtgcaattacgttatctagatctctccttcactaaaatcaaaagcttgcccaatacaacaagtaacctttacaatttgcaaaccatgattttagcatattgtcgggttctcactgaattgccattacatattggaaatttaatcaatttacgtcaccttgatataagtgggacgacaataaaggagttgcctgtggaaattgctagactagaaaaccttcaaactttgactgtttttgtagtggggaaacgacaagtaggattaagtatcaaagagcttagaaaatttccacatctacaaggaacacttaccatcaagaacctgcatgatgtcattgaggccagagatgcaggtgatgccaatttgaaaagcaaagagaaaatggagaagttggagctacaatggggcgaacaaactgaagactcgcgaatagaaaaagacgtgcttgatatgttgcaaccatcggttaacctgaagaaactaagcattgacttttatggtgggacaagttttccaagttggctaggagattcttcgttttctaacatcgtgttcttgggcatcagtaatggtgaacattgcatgacacttccaccgctggggcagctaccttctctgaaggacctactaatttgtggtatggagatattggagagaatcggtccagagttctatcatgtccaggcaggagaaggttccaattcttcctttcaaccatttccgtcccttgagtgtttaatgtttcgcaacatgccaaattggaaggaatggcttccctttgtaggcatcaattttgcttttcctcgtcttaaaattctgattttatctaattgtcctaaacttagggggtatttccctagccacctttcttcaatagaagtatttaaaatagaaggctgtgctcgtctattggaaacaccacctactttccattggatatcagcaattaaaaaaatacatattaaaggattttctgaaagatctcaatggtcgttggttgggagtgattctgcttgtcagctgcaatatgcaacgattgaaaggtgtgataagctattgtccctgcctaaaatgattatgaggagcacttgtcttcaacacttgacactcaatgatattccgtctctcactgcatttccgacggatgttcaactcacttcattgcagtcacttcatattagtatgtgtaagaatttatccttcatgcctcctgaaacgtggaacaattacacatcacttgcgagtcttgagttatggagcagctgcgatgcacttacctctttctcattggatggttttcctgcgctcgaaagacttcacatttatagttgtaagaatctagattcaatttttatttcagaaagtccttcacatcagccttcagtcctccggtcacttaaaatcaaatctcattactcaattggatctcttaaagtcaagcttcgaatggacacactcactgctcttgaagaactgtctctaggatgtcgagagttgtcattttgtggaggagtttccctacctcccaagttacaatcaattgatattcattcccgaagaacaacagccccgcctgtaacagaatggggtctccaaggcctaactgctctttcatcattgagtcttggaaaggatgatgatatagtgaacaccttgatgaaggagtcgttgctcccaatatccctcgtgtctctgactatctgtcatctctataatctgaactcctttgatggaaatggacttcgacatctttcctctcttgaaagtcttgactttcttaactgtcaacaacttgagtcattgccacaaaactgcctcccttcctcactgaaatcgcttgaattttgttattgtaaaagacttgagtcgttaccagaagacagcctcccttcctctcttaagcgactggtcatttggcgatgccctatattagaagaaaggtataaaaggcaggaacattggtccaaaattgctcacatccctgtcatagaaattgaggaccaagtcacaatatga

SEQ ID NO: 650 - DNA, 214 bp, Medicago sativa
gggaaatctgaaagaactaatcattgaagggatgcattcagtacagataattggtcctgaattctatgcaagtgattgttctccttcatttcaaccatttccatccttggagactctacactttgagaatatgcaagagtgggaggagtggaatttgattggaggtacaactaatgaatttcctagtctaaaaactttgttacttagtaagtgt

SEQ ID NO: 651 - DNA, 790 bp, Medicago sativa
attatttgtcctgggggaagtgttggaattcctaaaagagaaacaatctcctgagtggtgtgcacaaagattttttagacatcaaagatgaacttgagagcattcaagtcttcctcaaagatgcagatataagagctgcagatgaagcagacaccaatgatggaataagaacttgggtgaagcagctgagagaagcatcatttcgcattgaagatatcatcgatgaataccttcggctcatgcatagggcaaaatccaatccttctggatgccgtcaatctttattctgcaagattgcaagcctaatcaaaactttgattccccatcatcagatagcatctgagattaaaaacattaagatatcaattcgtggaatcaaggaaagaagtgagaggtataactttcaaatttcacagacaccaggatcatcaagcagcagcaacagcagtagagagacggacaatagaagatggcatgatccctcggttgtcttcccttttcattgaagaaactgcaattgtcggatttgaaggcccgagggaagaattgtctggttggttattggagggcacagctgagcgcacagtgatttcagtggttggaatgggaggtctaggaaaaaccactcttgcgtgcttgcatcaccgtttctcaatcattcaccgtgagggggatattgatcaacatgatggaggaattttgtagcgaaactgaaggccctcttttgcagatgttacacaaaatggatgacaagtcactcattctacaagtgaggggcatacctgaacat

SEQ ID NO: 652 - DNA, 6102 bp, Medicago sativa
atgggtacaaatacccaccatagcgagatgggtacacaagttgtcacccaatttaatacctgtgacaacaaggagtgtcatgattcttctcttcacaatgcacctcaggttcaggttcaggttcctaatcaaagaaattcaattgacttgacacttcaaaattcttttgaattgcttgaaaatgatgctgagcaggttataggggatgctaaaatcagtgatgaagaatctaaccccattctattggatatgtacattgacaaaaatcaaaatggggcagagaatttactaaggaaggaggaatttactcataacacaatcttagagagtactggtaacatgacaaatatgaaatctaaccttgttgatttgagtacatgtaacccttttttgggtcctgttaatgggaagaaggcatccctcattacagttccctttgttgatgatgccatcacattgcaacctataactataaatgatgaaattctaggccaagacaagaggaaggcgcaactcactgttggccctaaaaacaagattgctgcatgtttgaaagatggcaaggttttgagaaagttttggggggatgaagacactgatagtgcgtatgagcctgacattgaagccaacccttgccctccagatgctaatcagtatttggacactccttgtgacactgtgaagaaatccaaaagaggcgttgaggttgagcgatgtttgcatcgtggtggtgatgggtggcgagagaaaattgtgaaggtgaagggaagagacaaatctcagcgtgagagagaagaggcgaggtacgatgtgtacttgagtttctgcgaccaagacaaagacctgcattcttttgttttcagtatctataatgctcttagtagaaaagctggagttgatgttttctgggagaatgagagggatggctatggagatcgagaaaaaccaacctctgtgctcaatgttataagagattgcaaagtttttgtaattgtattttcaagagactatttcaattcaaggtcgtgtcttcatgaatttaaaaaaataactgagtgttgccgaaccaaagatgatcttatggttctacctgtgttctatgatggtgttgatctctcgttcggaagttgggaaagaggtatgtttggaggagagactttgcatgattgcgtggataaaatcttgatgaagaaaacctttaaagaggaagataagttcatgacttgggtggcatcaatcagcaaagctaccatatatacgggacaaagtgatctcgaagacaggaacagtagtatatatattgacgacgtagtcgaatgtgttactaatgtgctacgccactggaaagacttctcccgtgctttctgtccagtgagcataaaatctggtgtgcaagatgtgattcaactattgaaacaatcaaactctcctcttctaatagggatatgggggatgggagggattggtaaatcaaccattgcccaagctatttatgatcaagttggtccctattttgaacacaagagtttgctaaaaaacgtcaggacattttggcaacaaaatggaggtcaagtttctttacaaaagaaacttcttatggctgtcaacaaaacaactgaaaaaaagatacttcatattgaatcagggaaagtgattttaaaagaaagactccgtcataaaagtgtacttcttatacttgacgatgttaataaattggagcagctgaagtctttgtgtggaaatcgggattggtttggtccaggtagcaaaataatcattatcaccagagatagacatctacttatggagcatggagttgaccatatatataaagtgaaacaattggaagaaagtgaatcgattgagctttttaattggggtgcattcagccaagcaacaactcctcaaggttttagtgaactttctaggcaattagttgcttattctaagggattgcctcttgctcttaaagcccttggggagtttttgcatggaaaggacgcacttgagtggaaacgtgtgttgaagagtcttgaaagattttcctttcccgaccaagaagtactgcaagctctagagacgagttttgatgatttgaaggatgaagaaaaacatatattccttgatatagcatacaagagccttttaaccattggtgagaataacaagcttgaaatgcatggtctgctacaagcgatggcaagggatatcattaagagagaatcaagtaataagactgatcagccaaagatgtacgatgtgttcttgagtttcagaggggaagacagtcgtgcaaagttcatttcacatctctattcatctcttcaaaatgccgggatttatgttttcaaagacgacgatgaaattcaacgaggcgatcagatctcaatttcactattgcgagcaatcggacactctagaatttttattgtggttttatctacaaactatgctaattcaagatggtgtatgctagagttggagaagataatggaaattggcagaaccgggggtctggtggttgtaccagtgttctatgaggtagatccctcagaagtacgtcgtcgggaaggtcagtttggaaaagcttttgaaaaacttataccaacaatctcagtggatgaatccacaaagagtaattggaaaagagcactcttcgatattggtagcatagcaggttttgtactcatagattccaggaatgagagtgcagatatcaagaatattgttaaacacgtgacccgtttgctagataggacagaattattcgttgctgaacatccagtgggtgtagaatctcgtgtggatgctgtgactaagctactcaatatccaaaactccgaagatgttttacttttaggaatatggggaatggggggtgtgggtaaaacaaccattgccaaagcgatttataatcaaattgggagaaaattcgatggacggagctttcttttgaatataagagaattttgcgagacagatgccaatcatgtttctctgcaacaacaaatactttgtgatgtttacaaaacaacggcattcaagatacgcgatatcgaatcagggaaaaatatattgaaggaaagacttgcccagaatagggtacttcttgtgcttgatgatgtgaatgaattggaccaactaaaggctttgtgtggaagccgtgaatggtttggtccggggagtagaattatcatcacaacaagggatatgcatcttcttaggtcgtctagagttgacctagtgtatacaattgaagaaatggatgagagtgaatctcttgagcttttcagttggcatgcattcaagcaaccaagtccggcagaaggttttgctacacattcaacagatgtgattgcttattccgggagattgccactagcacttgaagttcttgggtgctatttgtctgactgtgaaataacagagtggcagaaagttttggagaaactcaaatgtattccccatgatgaagtacagaagaagctaaaagtaagctttgatggtttaaaagatgttacagagcaacaaatattccttgatatagcctgtttcttgattggaatggataaaaatgatgcaataaaaatattaaatgggtgtgggttttttgcggatattggaattaaagtccttgtagagcgaagccttgtaactgttgacaataggaacaagcttagaatgcatgacttgttgagagatatgggaaggcaaataatctatgaagaatcaccatttgatcctgagaaccgcagtaggttgtggcgccgtgaggaagtgtatgatgtattattaaagcagaagggaacagaagctgtcaagggactggctttggtgtttccaagaaaaaataaagtttgtctgaataccaaagcatttaagaagatgaataaactcagattgcttcaactttccggggttcagcttaatggagattttaaatacctttcaggagaacttaggtggctttactggcatggatttccattaacttacactcctgcagaatttcaacaaggaagtctaattgtcatccaattaaaatatagcaatctcaaacagatatggaaggagggccaggatgtcccaacatgcgatgggatgggaggtgtggagggacctccttcacctcatgttgtgggatctctggtagcctcagaggttttggagatgctaaagaatctaaaaattcttaatcttagtcattctttggatttgactgaaaccccagatttttcatacatgcctaatctcgaaaagctagtgctcaaagactgtccaagaccttctaaagcttcgaagtctttgtgtggaatgtggctcagatctacagctaatcaaaatgtagcaagagttttggaagtattaaaagccaaaaattgtcagagattggaagcaagtgcaactacatcacagatctctgatatgtatgcttctcctttaattgatgattgcctaggtcaagttcgcccttcagggtcaaataattacttgaaatctgtcttaattcaaatgggaacaaaacaccaagtcccgagtcttgccaaagatcgcatcttacagactgcaaatgggacttgggagtcatttttgcacaatagttctgagtggaaaacctttagttgccaaggatgttccattatatttgatatcccaacaatgaaggggcgtaacctgaagagtatgatgttgtccgtcatttattactcttcacaggagaacataacatcagaaggttgccaaggtgtgttgatcattaatcacacaaagacaaacattcaggcctataaaagagatacattagcctcctttgaggatgaggactggaagaacttaacatcaagtctagaacctggtaacacagtggaggttatggctgtttttgcggagggattcaatgtagaaaaaacaacagtatctctcttatatgatgaaccaattgacaaagaaatggaacagtgcaatgcaggagatgaggaggatattactgtttctggagatgtcaataagaatattaatgttggtgattatattgatgtgccagtgaataacaatattagtggtcctggtgaagataagcactcacatgcagtgaatacaaattgtattgtttctagtgacgatgagtcaaccgacaaagaaactgaacactgcaatggacgagatgaggcggatgttactgtttctgaagatgtcaataagaatgttaattttattgatgatgttacaaattgtattgtttctagtgatgatgagtcaaccgacaaagaaaccaaacactgcaatggaggagctgaggaggatgttactgtttctgatgatgagtatttcgatgcgccgtgggataataatttgattggtcctggtaaagataaacactcacatgcagtgaataaaaattctactgtttctagtgatgatgccctgacagcaaatcagaattatgctgtctcttttggtggtgatattccagcagataaaaatgttattgtttctggggaagatgaaaatgtgtccactggtagtgttgtgttcatgtttatgtcggtgcaagaaacccctcaactgcacttaaacatgaaacaacatgatgcagccgaccaagtacttgcctgtgaggttaagaaacttcgagaggatgaggaggtccctatgccgccagataggtggcatagacagatggacagtttccacctacttcctatggagatgaagatcgtgggtcaaaactcgtacaggaaatcatggagatcgaagccgcaagaggttgacatgtttgctttagttggtcctgtgatgtctaccaggagtaggtgtgcatggttgtgggtgccttgcatacttatacatgcatctagaggatcttatgtgacctatgcaagaaagttccttgaggtggtgggtcattgtgcgcaaggcgctacaacctctggtacaggagtaccatgtttagccgttgcgcgttgtcaacttgatgatattgccattgatttacgcccgacaacaatatctcttggtgtcaattgtggtgtttactcctatctccctatctccaactccagaaatgacagttttagtccaaccgcctatgttcaaccatga

SEQ ID NO: 653 - DNA, 6501 bp, Medicago sativa
tcatggttgaacataggcggttggactaaaactgtcatttctggagttggagatagggagataggagtaaacaccacaattgacaccaagagatattgttgtcgggcgtaaatcaatggcaatatcatcaagttgacaacgcgcaacggctaaacatggtactcctgtaccagaggttgtagcgccttgcgcacaatgacccaccacctcaaggaactttcttgcataggtcacataagatcctctagatgcatgtataagtatgcaaggcacccacaaccatgcacacctactcctggtagacatcacaggaccaactaaagcaaacatgtcaacctcttgcggcttcgatctccatgatttcctgtacgagttttgacccacgatcttcatctccataggaagtaggtggaaactgtccatctgtctatgccacctatctggcggcatagggacctcctcatcctctcgaagtttcttaacctcacaggcaagtacttggtcggctgcatcatgttgtttcatgtttaagtgcagttgaggggtttcttgcaccgacataaacatgaacacaacactaccagtggacacattttcatcttccccagaaacaataacatttttatctgctggaatatcaccaccaaaagagacagcataattctgatttgctgtcagggcatcatcactagaaacagtagaatttttattcactgcatgtgagtgtttatctttaccaggaccaatcaaattattatcccacggcgcatcgaaatactcatcatcagaaacagtaacatcctcctcagctcctccattgcagtgtttggtttctttgtcggttgactcatcatcactagaaacaatacaatttgtaacatcatcaataaaattaacattcttattgacatcttcagaaacagtaacatccgcctcatctcgtccattgcagtgttcagtttctttgtcggttgactcatcgtcactagaaacaatacaatttgtattcactgcatgtgagtgcttatcttcaccaggaccactaatattgttattcactggcacatcaatataatcaccaacattaatattcttattgacatctccagaaacagtaatatcctcctcatctcctgcattgcactgttccatttctttgtcaattggttcatcatataagagagatactgttgttttttctacattgaatccctccgcaaaaacagccataacctccactgtgttaccaggttctagacttgatgttaagttcttccagtcctcatcctcaaaggaggctaatgtatctcttttataggcctgaatgtttgtctttgtgtgattaatgatcaacacaccttggcaaccttctgatgttatgttctcctgtgaagagtaataaatgacggacaacatcatactcttcaggttacgccccttcattgttgggatatcaaatataatggaacatccttggcaactaaaggttttccactcagaactattgtgcaaaaatgactcccaagtcccatttgcagtctgtaagatgcgatctttggcaagactcgggacttggtgttttgttcccatttgaattaagacagatttcaagtaattatttgaccctgaagggcgaacttgacctaggcaatcatcaattaaaggagaagcatacatatcagagatctgtgatgtagttgcacttgcttccaatctctgacaatttttggcttttaatacttccaaaactcttgctacattttgaattagctgtagatctgagccacattccacacaaagacttcgaagctttagaaggtccttgaaagtactaagagatggcatggatgcagatgtttgaactagtgatatctcattataagatggtgacatccaagagcgaataagtgaaggaaacacatcccgtgaaaatccttcaaatccacataaagaaatatatccaatgtttttagatcgtactattgaaaagggaacttttgttatagcagtcttatccgcaatcaaggttgtcaatgattccatctgttccaagtcctcctccaatttgtcaatcatggaacatcctgaaagaattaaagtttctagagattttaatttatagatgcttcttggaagtttacgaagacgtatgcagtctgtcaaatttataaggagaagtttatggagagatccaatgctatgggagactgtagacaaacttggacagtctttgagcactagcttttcgagattaggcatgtatgaaaaatctggggtttcagtcaaatccaaagaatgactaagattaagaatttttagattctttagcatctccaaaacctctgaggctaccagagatcccacaacatgaggtgaaggaggtccctccacacctcccatcccatcgcatgttgggacatcctggccctccttccatatctgtttgagattgctatattttaattggatgacaattagacttccttgttgaaattctgcaggagtgtaagttaatggaaatccatgccagtaaagccacctaagttctcctgaaaggtatttaaaatctccattaagctgaaccccggaaagttgaagcaatctgagtttattcatcttcttaaatgctttggtattcagacaaactttattttttcttggaaacaccaaagccagtcccttgacagcttctgttcccttctgctttaataatacatcatacacttcctcacggcgccacaacctactgcggttctcaggatcaaatggtgattcttcatagattatttgccttcccatatctctcaacaagtcatgcattctaagcttgttcctattgtcaacagttacaaggcttcgctctacaaggactttaattccaatatccgcaaaaaacccacacccatttaatatttttattgcatcatttttatccattccaatcaagaaacaggctatatcaaggaatatttgttgctctgtaacatcttttaaaccatcaaagcttacttttagcttcttctgtacttcatcatggggaatacatttgagtttctccaaaactttctgccactctgttatttcacagtcagacaaatagcacccaagaacttcaagtgctagtggcaatctcccggaataagcaatcacatctgttgaatgtgtagcaaaaccttctgccggacttggttgcttgaatgcatgccaactgaaaagctcaagagattcactctcatccatttcttcaattgtatacactaggtcaactctagacgacctaagaagatgcatatcccttgttgtgatgataattctactccccggaccaaaccattcacggcttccacacaaagcctttagttggtccaattcattcacatcatcaagcacaagaagtaccctattctgggcaagtctttccttcaatatatttttccctgattcgatatcgcgtatcttgaatgccgttgttttgtaaacatcacaaagtatttgttgttgcagagaaacatgattggcatctgtctcgcaaaattctcttatattcaaaagaaagctccgtccatcgaattttctcccaatttgattataaatcgctttggcaatggttgttttacccacaccccccattccccatattcctaaaagtaaaacatcttcggagttttggatattgagtagcttagtcacagcatccacacgagattctacacccactggatgttcagcaacgaataattctgtcctatctagcaaacgggtcacgtgtttaacaatattcttgatatctgcactctcattcctggaatctatgagtacaaaacctgctatgctaccaatatcgaagagtgctcttttccaattactctttgtggattcatccactgagattgttggtataagtttttcaaaagcttttccaaactgaccttcccgacgacgtacttctgagggatctacctcatagaacactggtacaaccaccagacccccggttctgccaatttccattatcttctccaactctagcatacaccatcttgaattagcatagtttgtagataaaaccacaataaaaattctagagtgtccgattgctcgcaatagtgaaattgagatctgatcgcctcgttgaatttcatcgtcgtctttgaaaacataaatcccggcattttgaagagatgaatagagatgtgaaatgaactttgcacgactgtcttcccctctgaaactcaagaacacatcgtacatctttggctgatcagtcttattacttgattctctcttaatgatatcccttgccatcgcttgtagcagaccatgcatttcaagcttgttattctcaccaatggttaaaaggctcttgtatgctatatcaaggaatatatgtttttcttcatccttcaaatcatcaaaactcgtctctagagcttgcagtacttcttggtcgggaaaggaaaatctttcaagactcttcaacacacgtttccactcaagtgcgtcctttccatgcaaaaactccccaagggctttaagagcaagaggcaatcccttagaataagcaactaattgcctagaaagttcactaaaaccttgaggagttgttgcttggctgaatgcaccccaattaaaaagctcaatcgattcactttcttccaattgtttcactttatatatatggtcaactccatgctccataagtagatgtctatctctggtgataatgattattttgctacctggaccaaaccaatcccgatttccacacaaagacttcagctgctccaatttattaacatcgtcaagtataagaagtacacttttatgacggagtctttcttttaaaatcactttccctgattcaatatgaagtatctttttttcagttgttttgttgacagccataagaagtttcttttgtaaagaaacttgacctccattttgttgccaaaatgtcctgacgttttttagcaaactcttgtgttcaaaatagggaccaacttgatcataaatagcttgggcaatggttgatttaccaatccctcccatcccccatatccctattagaagaggagagtttgattgtttcaatagttgaatcacatcttgcacaccagattttatgctcactggacagaaagcacgggagaagtctttccagtggcgtagcacattagtaacacattcgactacgtcgtcaatatatatactactgttcctgtcttcgagatcactttgtcccgtatatatggtagctttgctgattgatgccacccaagtcatgaacttatcttcctctttaaaggttttcttcatcaagattttatccacgcaatcatgcaaagtctctcctccaaacatacctctttcccaacttccgaacgagagatcaacaccatcatagaacacaggtagaaccataagatcatctttggttcggcaacactcagttatttttttaaattcatgaagacacgaccttgaattgaaatagtctcttgaaaatacaattacaaaaactttgcaatctcttataacattgagcacagaggttggtttttctcgatctccatagccatccctctcattctcccagaaaacatcaactccagcttttctactaagagcattatagatactgaaaacaaaagaatgcaggtctttgtcttggtcgcagaaactcaagtacacatcgtacctcgcctcttctctctcacgctgagatttgtctcttcccttcaccttcacaattttctctcgccacccatcaccaccacgatgcaaacatcgctcaacctcaacgcctcttttggatttcttcacagtgtcacaaggagtgtccaaatactgattagcatctggagggcaagggttggcttcaatgtcaggctcatacgcactatcagtgtcttcatccccccaaaactttctcaaaaccttgccatctttcaaacatgcagcaatcttgtttttagggccaacagtgagttgcgccttcctcttgtcttggcctagaatttcatcatttatagttataggttgcaatgtgatggcatcatcaacaaagggaactgtaatgagggatgccttcttcccattaacaggacccaaaaaagggttacatgtactcaaatcaacaaggttagatttcatatttgtcatgttaccagtactctctaagattgtgttatgagtaaattcctccttccttagtaaattctctgccccattttgatttttgtcaatgtacatatccaatagaatggggttagattcttcatcactgattttagcatcccctataacctgctcagcatcattttcaagcaattcaaaagaattttgaagtgtcaagtcaattgaatttctttgattaggaacctgaacctgaacctgaggtgcattgtgaagagaagaatcatgacactccttgttgtcacaggtattaaattgggtgacaacttgtgtacccatctcgctatggtgggtatttgtacccat

SEQ ID NO: 654 - DNA, 3954 bp, Medicago sativa
aaaggttcgacgatcgctgttctctgctctacgacacggtgcatttgcgtcgttactattggatttggatttctgtaacttacgattcgcaaacgaaggatagatagaatgcaatttctgtgagattgaaacacgttttacaatccaattctttattttgttctcaatcccaagacgtgtccgctgcctccatgagagtatctgggtaaggacgttacctttttccggcaagcatcgcacaccatcgccccaaaagaggtttgaaccgttccttcactaaatggctgaaatacttgggtcattcctctcttccttgttagcatcaaaggtggataggatatccgttcaagactttaaagatttctttaagggcaacggtattgatgagaggcatctccaagacttaagactgcttttattatccgtcgctactgtgctcaatgatgcggaggagaagcaatttattgaaccatgggtgaaagagtggactgataaagttaaggatgttgcatatgatgccgatgacttaatggatgagctagtcaccaaggaaatgtattcaagggattttgcttcgtctctcaatccatttgctgaacgaccacaatctagagttctagagattcttgagaggttaagatccttagtagagctcaaagacattctcattattaaggaaggtagtgcaagtaaattaccctcatttacttcagaaacaacttctttggtagatgaacgtcgagtgtacggtagaaatgttgataaggagaaaattatcgagtttttgttatccaacaactcccaagatgtggaagtgcctgtagttgctattgttgggatggcaggagttggcaagaccactcttgctcagatattatacaatgattcacgagttatggaccattttcagtcaagatcgtgggcatccgtttcaggaaattcgaaaatgcaggaaataactaaacaagttcttgattcattcactttgtgtcaatctgatgtcgtggacttcaatggtctccaaattcggctaaaaaaagaattaacagggaaaaggtttttacttgttttggatgggttcgagaatgagaattatcttgattgggatatccttcaaatgccttttgtttcagaaaataatggaagtagaataattgttaccacacgtaataaaagggttgccacagcaatccgtgctaatctaactcatttccccccgttcctatctcaagaggcttcatgggagttattctcaagtcatgcattcaagtctcaaaactcaaatgaacgaagtcgtgttttgacagaaattggtaaaaaaatcgttcaaaggtgtggtggtctccccctagccacaattacactagggagtctcttaaattcaaaagaggacagtgaggagtgggaaaatgtttgtaccagtaaattatgggatttatcaagaggggggaacaacatattttctgcattaatttcaagctacatacgcctgcctccatatctcaagcggtgcttttcattttgtgccatctttccgaaaggccataaaatagaaaaagggaacttgatatatttatggatggctgaaggtcttttgccacgatcaacaatgggaaagagagcagaagatataggagaagaatgttttgaggagttggtgacgaagacgttctttcaccacacatcgaatgattttttaatgcataacattatgcatgagttagcagaatgtgttgcaggtaaattttgttacaagttgacggatagtgatccaagcacaattggagtgagtagagtgcgccgtatctcatattttcaaggaatatacgatgaccctgaacattttgctatgtacgctggtttcgagaagttgaggaccttcatgccttttaaattctaccccgttgttccttcgttgggtgaaatttccacttcagtttcaattctattaaaaaaaccaaagcctctgcgtgtcttctctttgtctgaatatccgattaccttattgcctagttcaattggtcatttattgcatttgcggtatttggatctttcttggactccaattacttctctacctgattctatctgcaatctgtataacttagaagcattattgctggtgggttgtgctgatcttactttgttaccaacaaaaacatccaagcttatcaacctacgacaattggatattagtggcagtggtataaaaaagatgcctacaaatcttggcaagttaaagtctcttcaatcgttgcctcgttttgtcgttaacaatgatgggggatcaaatgttggtgaattgggggagatgttggaacttcgtggctcactttccattgtgaacttggaaaatgttctgcttaaagaagaagcatccaatgctgggttgaagcgtaaaaaatatcttcatgaggtcgaattcaagtggacaactccaacacacatttccaaattggctagggagcaattcaagttctactatgatgtctctataacttctgttacaaggttgcaaaaggtgggtccggaattttatgggaatggatttgaggcatttagttccttaagaatcatcaagtttaaggacatgctcaattgggaagaatggtcagtcaataatcaaagtggaagtgaggggttcactttgcttcaagagctttacatagaaaattgtcctaaactgattggtaagttacccggcaaccttccttccttggataagttagtgatcacttcatgccaaactttaagtgataccatgccatgtgtcccaagattaagagaattgaagatcagcggttgtgaagcatttgtttccttatccgagcaaatgatgaaatgcaatgattgtcttcaaacaatggccatcagtaactgcccatctttggtcagcatccctatggattgcgtctcagggacgcttaaatctcttaaagtatctgattgtcagaaattacaactagaagagtctcactcctatcctgtccttgagagtttaatcttaagaagttgcgattctctcgtatcttttcaattggctttatttccaaagcttgaagatctttgcatagaagattgtagcagtctccagaccattttatctactgcaaacaatcttccatttcttcaaaacttgaacttgaaaaattgctcaaaactggctccgttttctgagggagagttttctacaatgacatcacttaattctcttcatcttgagagtcttcctacactcacttcactaaagggcatcggaatcgaacacttaacctctcttaaaaagctggagatagaggattgtggtaaccttgcctctctaccaatagtcgactcccttttccatctaactgtcaaaggatgcccgttattgaaatcgcattttgaaagggtcaccggagaatactcggacatgttggtgaggtgtttggcagtaaagcaaggaggctctgaaattgctcgtgttaaactggaaagtgttgaatcttactggattgcgaccgcagtgagtgcattgccttgcatttcctggttaggaggcacaggacatgttcgatttctctttgttttggttgctgttaggtgcagtttggacgacaagaacagatgtttcttcaagggtggtgtcatgaatgtgcctttcttgtgtacaaccatggagaataagttggtgattgatggcagggcttctttaacaagatctgggattggactatggacaacagcaagattctcattcagcccttgcaggaacatatcattctgagctttataaaattcattatagagtcgctttgggacccgagaaatgggatgccgctgcagtttcaaacaggcactacctagggaaaaatgctccttaaggtcttgccaggccaaataacgcttattgttatatacggtgagattgagtggcttatccaagaaattagaaaagtattgcatcttttccat

SEQ ID NO: 655 - DNA, 4911 bp, Medicago sativa
atggcgactattgtgggagaagcacttcttgcagcttctttggaagtgttgatggaaaagattgtttctggtgagttcgttgatttatttcggagcaccaagcttgacgttgcacttttggaaaagctgaagataacaatgttgagtcttcaagctgtacttcatgatgctgaggagaaacagatcaccaaccctgctgtcaagcaatggctggaaatgctgcatgatgctgtctttgaagctgacgatttatttgacgaaatcaacacggaggcattgcggtcaaaagttgaagctgagtatgaaacccgaactgctactgctcagaatcttggattgaaagaaaggggttccagtagtgtttggcatatatctcctacaagttctgttgtgggtgatgaatcttctatttgtggtagagatgatgacaaaaagaaactgaaagagtttctgctgtcagaggatagtagtgatggtcgaagtaaaataggagtgatttccattgtaggtatgggagggctagggaaaacaacattagctaaaatcctttacaatgattccaatgtgaagcggaaatttgaggcgagaggatgggcacatgtctcaaaagattttgatgtttgtactatcactaaaacccttcttgaatctgttacttctgaaaaaaccacgactaatgatttgaacggtttgcaagttcaattgcagcaaagtttgcgagacaaaaagtttttgctagtattggatgatatatggtatggaagatatgttggttggaataatctgaatgacatctttaatgttggggaaatggggagtaagatcattatcacaacacgagatgaaagagttgcattaccaatgcaaacctttctttctgtccaccgtttaagatctttggaaaaggaagattgttggtctttacttgccagacatgcatttgtaacaagtaactaccaacaacgatccaatctagaaaaaattggtagagaaattgccaaaaaatgtgatgggttaccattagctgcaatagcacttggaggttttcttcgcaccaaattgtcacaagattattggaatgatgttttaaaaagtagtatttgggaattgacagatgatgaggtgcaaccagctctgctattgagctatcgtcatcttcctgctcctataaaaggatgctttgcttattgttcaatttttccgaagaactcaatcatagagaaaaaaatggtagttcaattgtggattgcagaaggcttagtacctaagcccaaaattgagaaaagttgggaaaaagaagccgaagaatactttgatgaactagtgtcgagatctttgttacgtcaaaattcgactggtgatgaggaaatgggctttgaaatgcatgacctcattaatgatttggcaatgatgacacagttacacgtactgtctttgtcaaactacaagaatatcactgagtttcccaattctattggaaatttgatatacctgcgatacttaaatctctctcacactgagattagaatgttgcccgctgaaacatgcaagctttacaatctgcagaccttgttgctgtcagactgcaacagactgactgaattgccgaaagacatggcaaagttaatgaatctacgtcaccttgatatcagaggcactcgattgaaggaaatgcctgtgcaaatatccagactagaaaatctccaaactttgtcggactttgttgtaggtattcaggacgatggattgaagatttcagatttgggaaaacattcccatctacgggaaaaccttaccatctcacaacttcaaaatgtaactgattcatcccatgcttctcaagcaaacttagtgatgaaaaaacaaattgatgagttggtacttcaatggtctggcactagtccatcaaattcacaaatacaaagtggtgtacttgaacaattgcagccatcgacaaatttgaagagtctcaccatcaatggctatggtggaaacaactttccaaattggttgggtagttctttatttggcaacatgatgaaatcaataaagaggattggtaccgagttcacgggaagtatttctcattcgtttcaaccattttccttcttggagacactagagtttgatacaatgctagagtgggaagattggaagttgattggaggtacaactgcagagtttcctcgtctaaaacgtctgtcactacgacaatgtccaaaactcaaaggaaacttaccccttggacaattacagaatcttgaagagatcattcttgaagggatgaaatcattaaagacacttgatactgggttttatggaagtagcagttctcgtttgtttcaaccatttcccttcttgaagactttgagctttacgaatatgcaagagtgggaggaatggaaactgattggaggtgcatctatcgagtttcctagtcttacacgcttgttactatgtaattgtccgaaactcaaaggaaatataccaggaaaccttcctagtcttacaagtttgtcacttaaatattgtcccaatctcaaacagatgtcgcccaacaactttccttcccttgttgaacttgagttagaggactgttctctactgatggaggcaaggcattcatcagatgtgttcaaccaattgatgattttcctcaatgctcttcgaaatatttccttaaggaatattccatctctaacgtccttcccgagaaacggtctgcccaaaaccatacagtcgcttaaaatctggaagtgtgagaatctagagttccttccttacgaatcctttcacaattacaaatcacttgagcatttggaaatatccgatagttgtaattctatgacatcgtttaccgtatgcgctctccctgtccttagaagtctatgtatttacggcagtaagaacctgaaatcgatattaattgcagaagatgtgtcgcaacagaaactcttgcttcttagaaccatcaaaatagagcattgcgatgaactggagtcattttcccttggtggatttcccattcctaacctcattcatttatctgtttgtaattgtaagaagctttattcgctaccaagatcaataaatatcctagctagtcttgaagaaatgaaaattcacgaccttccaaatctgcaatcgttttccatacatgattttcctatcagcttacgggaactgagtgttggcaatgttggaggggttttgtggaatacaacttgggaacgtcttacttctcttttagagttgctaatttggggtgatgacattgtgaatgtgctgatgaaaacggaagttccattgctacctgcttctctcgtctctttaaagatctctttacttgaagacataaaatgcttggatgggaagtggcttcaacatctcacctctctccaacattttgatattattgatgctcccaagctcaagtcgttgccaaaaaaggggaagttgccttcctcccttaaagtgttgaatatcaaaaagtgtccgttgttgaaagcaagttggcagaagaagcgagggaaagagtggcgtaagattgctcacattccatcggaatttgttggtttcataactctaatttctagctgtatttcaatggctccgcctatttgttcttggtcgtttctgtcgtcacctgagacggcgccgccgggacaaaagtcattcacccaagcggtgttcgctgctgtggaggacagtttgccttcgcttcctcctaaggttatcgtcggagtcaccgttcgtatcagaatcactcaacgcgagtatgaagccgaactctctgtcaacgaaattcctgaagcagaaattggaaagtatgtggccaaatttgaaaccttgggccatcactcccgcttggcagaggtctgggcgttgggtgctgttcagctgaagcctgggctcctgcgtttcttttgctggtctaaagacttcgatcctcacaatcaaacacaatctcacgctcaattgtgggtaagacttctgaatcttccccaagaacattggagaaagatcactttatttgaaattgcatcaggaattggtacccctctaactatagatgaagcaacacaatcccgtctttttggtcactacgctcgtattcttgttgatgtggatatgtctgatacactttttaattctgttgtggttgagagggaaggttatgctttcccgcaatactcaatagagctaacaaaggagcgaattgagggagtccacgtggagcacatcgagatatctgggttgccgatgttgaacactgatcatgaggtggatggcacgtatccgacggaagcggaagtgttttgtcagaaggttctagaagctaattcatatctctttgcttatcctgattacaactactccatcactcgtattgtatctttggcaccattgaagaatgcattagattggggatcaagaccatcaaatgtgtgggcagggaaagctgctgcagctgtaagtgctgttggtgaagcactccttgcagcttcttttgaggtgttgttggaaaagattgtttctggtgactttgtggacttctttcggagcaccaaactcgatctttcactcttgaaaaagcagaagataacactgctgagtcttcaagctgtacttcatgatgctgaggagaaacaaatcaccaatcctgctgttaaagaatggctggatatgctgcaagatgctgtctatgaagctgacaatttgtttgacgaaatcaacactgaggcattgcggtgcaaagtgaaagccgagtttaaaagcaaaaatgctactgctaagaaacttggattaaaagaaggtatttctaccggtgtttggcatgggactcctacaagttctgtagtagatgattcttctatttatggtagagggttacattgtgagattttttag

SEQ ID NO: 656 - DNA, 690 bp, Medicago sativa
  misc_feature (650)..(650): n is a, c, g, or t
cacttgcttccgctagcccatgatcatttgcttccactcttgaaggaagcattcaatatgattagggttgtcccaaaagaaattgcagaattgaaagaggaacttgaaagcattgaagacttcaagatcgcacagttgtctccattgttggaatgggaggactgggaaaaaccactctagccagaaaagtttttgacaaccaaaaggtagttaagaactttgattgttatgtatatggatcacggtatctcgaccatacaacatagaaaaagtgttgagggacattttgctggagatttacaaacaacgaaggaaagatcctcctcagagtctccatcaaatggatcgaaagccattagttgatgaagtgagaaacaacttgcaaggaaaaaggtacgttgtagtgtttgataatgtataggagtcacatttttggcaagatatttgaatttgctatgattgataacaaaaatggttgtaagatattaatcacaacaagaaacaaggatgttacagatgattgtaagaaatctttcggtaaagtgcatgagctggaacgtttatctgaaaacaatctttggatttgtttaaaaagaaggcgttccgtgacttggacggattttgtccaaaaaatcttttttattatcttncgaattattgaaaatgcaaaggatacctctcgcattgtag

SEQ ID NO: 657 - DNA, 639 bp, Medicago sativa
ggcacgaggaagaagtgaaaggtatggcttccaaatccaaccttctattgaacaaggatcaagccactttagaggaagccaaaaggcgaaatggcatgaccctcgaatggctgctttatatattgatgaatctgaaattgtaggctttcaagaacccaaaaatagattgattggattgttggtggatggaagagaagagcgaactgtcatctctgtggtaggaatgggaggacaaggaaaatccactcttgccaaaaaggttttcgacagcaaagaggtcatgggacacttcgaatatcgtgtatgggtcacagtgtcacaatcatacgatatagaggggttgctgagatacatgttgaaggagatttaccaacaaaaaggagacgacccttctcaagatatctctgaaatggatctagggtcattgatttctaagttgagaaaccacttgcaacaaaagaggtatgtttttgtatttgatgatgtatggaccatagatttttggaatgaaatagagcatgttgtgattgataataaaaatgggagtaagatattgattacaacaagaagtatggatgttgctatttattgtaaaaaatcttcttttattgaggtgcatgaactacaacctttaactga

SEQ ID NO: 658 - DNA, 2868 bp, Medicago sativa
atggcagaaactgcagtatcgtttgtcctgggggaagtgttccagttcctaaaagaagaaacaaatcttctgagaagtgtacacagagatttttcagacatcaaagatgaacttgagagcattcaagtcttcctcaaagatgcagacagaagggctgcggatgaagcagacactaacgatggaataagaacttgggtgaagcagctgagagaagcatcatttcgcattgaagatgtcattgatgaataccttcggctaatgcatagggccaatcctcctagatgcggatctttagtcggcaagattgcaaggcaaatcaaaactttgattccccgtcatcatatagcatctgaaattcaggacattaaattatcaattcgtggaatcaaggaaagaagtgagaggtataactttcaaatttcacacgaacaaggaacttcaagcagcattagcataggagagagagaaaatggaaaatggcatgatcctcgactgtcttctctttttattgaagaaacagaagttgttggtattgaagtcccaaaagaagaactgtctggttggttattggatggtgaagctgagcgcacggtgatatccgtggtaggaatgggaggcctaggaaaaaccactcttgccaagctagtttttgaaagcaaaaaggtatcagcacactttgattgtcgtgcttgcgtcacagtttctcaatcttacactgtgagaggtttgttgataaacatgatggagcaattctgtcggagtactaaagactctcttctgcagatgttacacaaaatggatgaccagtcactaattatagaagtgaggcaatacctgcaacataagaggtatttgatattctttgatgacgtatggcaagaagattttgcggaccaggttcaatttgccatgccaaataacaataaaggtagtaggattatcatcaccactagaatgatgtatgttgcagattttttcaaaaaatcctttctaactcatattcacaacctgcaacttttgcctccaaacaaagcatgggaacttttctgcaagagagtatttagatatgagcttggtggacattgtccatcagaacttgaggctgtgtcaaaagaaattgttcaaaagtgcaggcagctacctctagcaattgtagctattggtggtttactttcaacaaaatctaaaacaatgattgaatggcaaaaggtgagtgaaaatctgagtctggaattaggacgtaatgcccatttaacgtgtctagtaaagattctatcacttagttatgatggacttccttattacttgaaaccatgcattttgtattttggtttatacccagaggactatgcaattaatcataggagattaactcgacaatggatagctgaagggtttgtaaaattggaagagagaagaactccagagcaagttgcagaagagtacttgtctgaattgattcagagaagtttggttcaggtctcaaatgttggctttgaaggaaaagttcaaacatgtcaagtccatgatttaatgcgggaattgatcattagaaaaatgaaggatttaaatttcggtcattgcatgcatgaagatagtgaatcagttgcacttggaagaactagacgcctatctatagccactaatcccaacaatgtgttcaggagcactaataatttacaatttcgggctatttatgtgtttgaagaagatggatcattggagcatttcatgggtaaagtttgttcgcagtcaagaattttgaaggtccttgacattcaagggacgtcgttgaatcatatccctaaaaatttggggaatctttttcacttgcggtacattaacctaaggaatacaaatgtaaaggctcttcctaaatctattggtgagttacataacttagagacattggatttaagagaaacactagtgcatgagatacctagtgaaataaacaagctgacaaagttacggcatctgcttgcttttcatcgcaactatgaacaaaaatattctgctttgggctctacaactggcgtgctgattgaaaaaggtattaaaaacatgatttccctaaaaaacctttattatgtggaggtagatcatgggggagtagatctcattgaagagatgaaaatgctaaggcagttaaggaagttaggtttaaagcatgtaagaagggaacatgggaatgccataagtgctgcagtacaagagatgcaacaccttgaatcacttaatatcactgcaatagaagaggatgaaattattgacttaaactttgcgtcaaccccaccaaaacttcaacggctccatttgaaagctagactagagaagtttcctgattggattccaaaatttgagtgtcttgttcagatttgtctggctttatccaagctgaaagatgatccgttgcagtcactgaaaaatttgccaaatcttctgaagctcaatttgttggagaatgcctttgatggtgaaattttgcattttcaaaatggaggatttcaaatattgaaagaactgattctcagtcacttgaatagaccaaattctatccttatagagaaaggagctttgctctctcttgaaaatcttaaattggaaaggatccccaaactaaaggatgtgccttctggcatcaaacacttggataagctcaaagtcattgacttagttgatatgccagatgaatttgttaagagcattgatccagacggaggacaagaccattggattataaaccatgttcctattgtgttcattcgtcaatggtttggcccaaaatactatgattatgaggttcgcactattaactcatccaccaaagaagtcctgagagatgagaatgctaaggtgtctagctag

SEQ ID NO: 659 - DNA, 1656 bp, Medicago sativa
atggcaactgttgtgggagaagcacttctttcagcttctgtgaaactattgttgcaaaagatggtttctagtgaattcattgacttcttttggagcatgaagcttgacgttgcactgttggaaaagctgaagataacactgctgagtcttcaagctgtactgaatgatgctgaggagaaacagatcactaatcctgctgtcaaggagtggttgaatatgctgcaagatgctgtctttgaagcagaagatttgtttgacgaaatcaacactgagtcattgcggtgtaaagtggaagctgagtatgaaacccaatctgctaaggtactcaaaaaactctcttctcgtttcaaaaggtttaatagaaagatgaattctaaattgcaaaagttacttgaaagattagaacatttgagaaaccagaatcttggtttaaaagaaggtgtttccaacagtgtttggcatggaactcctacaagttctgttgtgggggatgaatctgctatttatggcagagatgatgacaaaaagaaactgaaagagtttcttcttgcagaggatgttagtgattgtgggcgtaaaataggagtgatttccattgtggggatgggagggctaggaaaaacaacactagctaaaatcctttacaatgaccatgatgtgaagcagaaatttgaggtaagagggtgggcacatatctcaaaggattttgatgttgtcatcgtcactaaaaccattcttgaatccgtcacttcaaaaagaaatgacactgatgacctgaatattctacaagtgaaattgcaacaatgtttaagcaatacaaagtttttgcttgtactggatgacatatggtatggaaactatgttgactgctggaataatttggccgacatctttagtgttggggaaatagggactgcaatggcaataggaggtcttcttcgcaccaaattatcacaagattactggaacgatgtattaaaaagtaatatatgggaattgacaactgatgagttgcaaccatctctgatattgagctatcgttatcttcctgctcctttaaaaagatgctttgcttactgttcaatttttccgaagaactcaattttagagaaaaatatggtcgttcagttgtggattgcagaaggtttagtacctcagcctcaaagtgagaaaagttgggaaaaagcagccgaagaatactttgatgaactagtgtcgaggtgtctgatacatcaaaggtccggtgatgatctggtcgtaaactttgagatgcatgaccttgtcaatgatttggctatgacagtttcatctccatattgtattaagttggatgaacagaagccaaatgaaaggaccttattgctgtcattttcctatattctcactgaattaccgaaagacttggggaaattagtgaatctacgccaccttgacatcagaggcactcgactgaaggaaattcctgtgcaaatatccaaactagaaaacctccaaaccttgtcgggatttcttgtcaatgttcatgacgttggattggagattgcagatatgggacagaaaggagtagaaaaagaagaaagactcgtcaacacaagtcaaaagagggagaagagaagaaaagcacaggaagtatcaactgtgaatttcggtgtgtag

SEQ ID NO: 660 - DNA, 3555 bp, Medicago sativa
atgggggctcatgccctgaaactccccacggatgaaaacttgcaaaaacgtgagtgcaccttggtctccatttgtggtttatgtttcaaacaacctgaatcttccgctcatttattcctcacttgtgatttcgcggttgctgtgtggaagtgcattggtttgaagctcaaccgtgttgttcctctgacatcggttttggctattttagagtgtgttcatgtggtggaatcttccgtgattttagagtttgctgctaagcataattggaatcggttgtggcttgaatgtgattcgactagtgtggtgcatgctttcaagaacccagacgttgttcctattcgtctccgaaacaggtggcataattgttttcaacatggtatgatggctcatttgtctgcaatcttgcaagtactgttggataggatagctcatcctgattttatcgacttctttcgaggaaaccatcttgatgagacacttctagacaagttgaagatgcttttgctatctgtcactatagtgcttaatgatgctgaggagaagcagttttttgatccattcgtgaaggaatgggttgataagcttaagaatgctgcctatgatgctgatgatgtcttggatgagattgccaccaaagccatacaagacaagatggatcctaggttcaacacaaccatacatcaggtaaaagattatgcttcctctctcaatcccttttctaaacgagttcaatctaaaattggtaggatagttgagaggttgaaatctatattagagcataaaaatcttcttggtcttaaggaaggaggtgtaggtaaaccactctcgttaggttcagagacaacttctttggtggatgaacatcgtgtgtacggtagacatggtgataaggagaagattatagacttcttgttggctggagactccaatggagagtgggtgccggtagttgcgattgttggaacgggaggggtaggaaagactactcttgctcaagttttgtacaatgatgaacgtgtgaggaaccattttcaatctagatcatgggcctcggtgtcagagacttcaaatgtgaatgaaataaccagaaaagcttttgagtctttcactttgatgtattctaatatctcagacttgaatatactccaaatcaaacttaaggatagactggccggacaaaggtttctacttgttctggatgggttttggaatgagaactttcttgactgggatatcttccaaagaccctttctatcaggaaactatggtagcagaatcattgtcacaacgcgtagtcaaagttttgcaacattgatcggtgctgatttaaatcattccctctcgcatttatctcatgaagatacttggaagttattcgctagtcatgcattcaaatcagtgaacccgaccgagcatcccatgttggctcaaattggccaaaaaatagtaaaaaagtgcaatggtctccctctagccgcaaaagcactagggagtctcctacgtacaaaagatgttggggagtgggaaggtatatgttatagtaggatatgggaattaccaactgataagtgtagcattcttcctgccttaagattgagctacagtcatctaccttctcatttaaagcgatgttttacttattgttccatatttccaaaaggatatgaaataaaaaagtggaacttgatctatttatggatggctgaaggtatcctaccacaacaaagaacggataagagaatggaagatgtaagagaagaatgctttgaagtgttactatctagatcgttcttttatcaatcaacctaccatgcatcacattatatgatgcatgaccttatccatgatgtagcacaatttgttgcaggtgaattctgttacaacttagatgataacaatccaagaaaaatcacgactattgttcgccatttatcttatttacaaggtatatatgatgatccagaaaagtttgagatcttttctgaatttaagcagcttagaaccttcataccattcaaattctcatactttgtttactcctcttcaattactagcatggtttcaattttgttaccaaaattgaaacgcttgcgtgtgctctccttgtctcattatccaattacgaatttgtcagattcaattggagttttgatgcatatgcggtatttggatctttcttacacaggaattgagtgtttgcctgattcagtgagcactttgtataacttggagacgttgttgttatccggttgtcgttgtctcactatattaccagaaaacatgtccaacctcatcaacttgcgccaacttgatattagtggaagcaccgttacatcaatgcctccaaaatttggtaaattgaagtctcttcaagttttgaccaattttacagtaggcaatgcaaggggatcgaaaattggtgagctagggaagctttcgaaactccacggaacactttcaattgggagcctacaaaatgtaattgatgcaatagaagcctctcatgtccagttgaagagtaagaaatgtcttcatgaactagaattcaagtggtcaactacaactcatgatgaagagagtgaaactaatgtactcgacatgcttgagccacatgaaaatgtaaagagacttcttatccagaattttggcggcaaaaaattgccaaattggttagggaactctccattttctagcatggtgtttctacaactaactagttgtgaaaattgcaagtcactgccatcacttggacaattgtcctgcctcgaagaactttgtatatcaaagatgaaaagtttacagaaggttggtctagaattctatgggaatgtaattgagccattcaaatcattgaaaattatgaaatttgaggacatgcccagttgggaagaatggtcaacccatagatttgaagagaatgaggagttcccttcactcctagaacttcacatagagagatgtccaaaattcaccaaaaagctacctgaccacctcccttccttagataaattaatgatcactggatgccaagctctaacaagtccaatgccatgggttccaagactgagagaattagtgctgaccggttgtgacgcgttagtgtcattatctgagaaaatgatgcagggaaataaatgtcttcaaatcattgccataaacaattgctcatctcttgtcacaatctctatgaatggtctaccaagagggttgcatgctccaaaacttgagtctctttccatcatcaaatgtgttgatttctcatctgagactgcatggtgtcttcagacaatgacatctctatcttctcttcacatcagtggacttcctagtctcacttcactagagaatacaggagttcagttcctaacatctctcaaaagtttgaagattaaagcttgttttaaccttggatctcttcctttagacacactagttaactccctttctcatcttactatcagagcatgtccattgttaaaactgctatgtaaaaaagacacgggggaatactggagtatggtctctcgcatacccttcagaatcattgaagactag

SEQ ID NO: 661 - DNA, 1045 bp, Medicago sativa
tggtaatagttcattttacccaccattagtatcaaatggctcgagagaaattgtactgggaagtatatgaaacttccccaaacattacagacccagaaatttatcataaaggacacaccaacttcaatcatcatcatttgcttccactagcccgtgatcacttgcttccactcttgaaggaagcattcaacatgattaggggtgtcccaaaagaaattgcagaattgaaagatgaacttgaaagaattgaagtcttcatcaacgatgcggatagaagggctgatgatgtagaagacaagaaaatcaaagacatgatcaagcagctgatagaagcatctttccacatggaagatgtcattgatgattatatcttccatgaggaacaacatgctcctgatcctggatgtgctgctggagccgttgacttggtgaaaactaagattcttcgtctccaaattgcttacaagattcagaacatcaaatcccgaataagtgaaataaatgatacaagaactgaaaaagatcatggcttctatatccaatcttcatcggataaagcatcaactagttctgcaacaaacagaaacgcctcactatttcagaaccttcgagacgctccactttacatggttgaagctgatgttgtaggatttgataagccaagagacgaattgattgatcttttggtagcgggaagagcagaccggacaattgtctccatctttggaatgggaggacaaggaaaaaccactctagcgaagaaagtttttgacaacccaaaggtcgttaaacactttgattgtcgtgtatggatcacggtgtctcgaccatacaatacagaaaaattgttgagggaaattttgctcgatatttacaaacaacaaggggaagatcctcctcagagtctccatcagatggatcgaaagccattagttgatgaagtgagaaactacttgcaaggaaaaaggtgatggttatcagtggatttgagattcgaaattcatcaagtggactattatatcagcattgcttctttctgtacctg

SEQ ID NO: 662 - DNA, 610 bp, Medicago sativa
aagaattaaatatggagtggagttacaaattcaacaccaatggaagagaatcagatgtctttgaggctcttcaaccaaatagcagcttgaagaggcttatcatctcacactacaaaggtaataggtttgcaaattggatgaggggttgtgatttacccaacttagtttcaattagactaaatctctgtgctttatgttccgagttgccaccacttggacaactcccttgtctcaaagagatttcaatttcaggctgtgataaaataaggatcatagggaaagaattttatggcaataattccacaaatgttccattcagatcccttgaaattctgcattttgattcgatgtcggaatgggaggaatggtcacatcttgaagggtttcctttgcttaaagagctttctataaaaaaatgtcccaagttgaaaagggctctgcctcaacaccttccttctttacagaaactggagattaaagattgcaagaagttggaagcattaattccgaagtgtgataatatgatagagttagatataaagagatgtgatagaattttggtaaatgaattgccgacaaatttgaaaagtttattcctttgtgataatca

SEQ ID NO: 663 - DNA, 1167 bp, Medicago sativa
tgtgaggaaaaaagaatgttatcttgtcttacacatgtgctttttgtttaggtttacttatgtgatgatggtttgacattaccaataatctttttcaaaattccatacaccaatatatagtgattgaaaagattgttgaagagataataaatagattgggttaccggttttcaagtcttccaaaagatttagttgggattgattctcttatagaagaattagaaaaagtgtttacttttggaatcaactgatattatacaggttgtaggaatttatggaatgggaggaataggaaagacgactctagctactgctctttatgacagaatctctcatcaatttgatgcatgctgcttcatcgatgatataagcaaagtttatagaaatgaaggtcgattggtgctcaaaagcaagcactacatcaaactcttagcaaacagcaccttcagatatgcaatctttacaacaaaaactaatttgatacgactcaagctaggtcatataagagcccttctagttcttgataatgttgatcaagttgaacagcaggagaaattagctgtgagtagtgaatgtttaggtgctgggagtagaattgttataacttctagagatgttcatatcttgaaagagtacgaagttgatgaaatcgtcaattaattttgtcaaaaagctttccaaggtggtaaaattaaaagtaactatgaggagttgacatgtcatattaaattatgttgatggcctaccaccggcaattaaagtattgggctcattttgtgtggtcgaaatatctctgaatggacaagtgcattggctagattgagagaaaatccaaataaagatattatggatgtgctgcgattaagttttgaaggactagaggaatcggaaaatgtgatatttcttgatattgtttgtttatttaacgggcatcacgagcaatttgttaacaatgttcttaattgttgtggactccaccctgttattggattaaaagttctcattcagaaatcacttgttagcatttctgacaaaaaaaagaacgttgaagccatagttttgaagaagcaatatccaagcgaaatagaaacattggcgacagaaacattgtcaaatatggatcatcttagattacttatgttcaacattatccgatgcaaggactga

SEQ ID NO: 664 - DNA, 762 bp, Medicago sativa
gcttcttcaattctttctatatatcccagatcaaacaaccttagccccttagacctttgtctttgctttttccaagaagagaaaaaagagaaaaaagacaagactaaaatatacctacaaagagagttgcaccaagaaacagagatgggtagaccaccttgttgtgataaaacaggggtgaagaaaggaccatggactcctgaagaagatattatgctagtctcttttgttcaagaacatggtccagggaattggaggactgttcccactcatacagggcttcggagatgtagcaaaagctgcagactaaggtggactaactacctcagaccaggaatcaagagaggtagcttcactgatcaagaagagaagatgattatccagcttcaggctcttttaggcaacaaatgggcagccatagcttcatatctcccagagagaacagataacgacattaaaaattactggaatactcatttaaagaagaaactgaagaagcttgaaacaagtggtttatactcaaatgatggacattgtttatcaacatataattcaacttccagaggccaatgggaaaggacacttcaagctgatattaacacagccaaacaagcttttacaaatgcactgtcactcgataaatcaagcccaattcctgactatacaattactgatattgggatgttacccatacattaaacaagagcaaaaatgtctactactacttacgcatcaaatgcttgaaacatagccaaatactcc

SEQ ID NO: 665 - DNA, 768 bp, Medicago sativa
atgagaggtatggatattaaggttcagaaaggtgggtctgcaaaggaaaatgagacaggggtaagaaaaggtccttggacgttagaagaggacaccattctggttgattacattacaatacacggtgaaggtttgaggagaagtggtaaaagttgtagattaaggtggttaaactacttgcgtcccgatttacgtcgtggaaatatcacacttcaagaacagatattgattcttgacctccactctcgctggggcaataggtggtcgaaaattgcacaacatctaccaggtagaacggacaatgaaataaaaaactattggagaacaagagtgatcaaacaagcaaagcaactcaaatgtgatgtaaacagcaaacagttcagagatgtattgcgtcacgtttggatgccccgattactcgaacaaattcaacccgcaccacaattccccgacacgaataatccaaacggatcacatatccttcttcaccaaaacacattgcaaagttcagtttcaggaatcagtggtatttcctcggactcttcatcagtagaattccaagttgcttcaaattcggaccaaaatgattcttcggagcttttgggccatgaaggttcaaaactatggtcaagtttcaataaccagcaggtttcagaacaggagaagagcggtgcttgtgatggtgactcgttgtggaacgatgagaacatgtggtttttgcaacaactttatgaagatgttgaaataaaatacaatttacttgcgtga

SEQ ID NO: 666 - DNA, 1204 bp, Medicago sativa
ctctcaaaaatattgcttgcttacctcctcaaactaatatcaaagcaaactctcacaaacttctcaaatcaaaagcttatcttttgatatatcatcactttgtgttcaaacatatacatatccaaagtagggtgatcaaattttcaatatttcatggaagtggaaggaagtgtaataagcaactcaaacagcaccatgctccaaagtgatgatgagttggatcttcgacgagggccatggaccgtcgatgaagatcttgctctcatcaattacattgcaaatcatggtgaaggtcgatggaatactcttgctcgttccgctggactcaagcgaactggcaagagttgtagattgagatggttgaattatcttcgtccagatgttcgtcgtggcaacatcacacttgaagaacaacttcttattcttgaacttcatagtcgttggggaaaccgatggtctaaaattgctcaatacttaccgggaagaacagacaacgagatcaagaattattggagaacccgtgtccaaaaacatgccaaacaactcaaatgtgacgtaaacagcaagcaatttaaagatgctatgcgatacctttggatggccaaggctagtggagcgcatccaagctgccgcatccacctccgccaccctagccaccgccactaataatggtttaccaagtggtacaacgacggtcaccaccaacaatacaccatacaacataaacaacaattttgatgtccatagtgacgcgaacatgttaactccaacaattatgaacaccaacagtttatgtggttcacatgttgcacaaagttataccccggaaaatagtagcaatggcgccgcagcagcatcatcggattcatttgggacacaagtttcgcctatctcggaattgactcaagattactacaatgtcccagttggtagtaacaacaataataaccctaattctgattattaccaacaagctcaacaatttgggttttttgattgcataactagcccatctggattgttccctcaaatggatttcaattccatggaaccaaacactccttggattcaaggggacacatctgacaatttctggaatgttgaaaacatgttgctctttcaacatcccaatgacaacatgtgaaagtaaggaaaaggagttataatgaaatatatattacagatgataaaataatagaagtag

SEQ ID NO: 667 - DNA, 1252 bp, Medicago sativa
taaatcaaaatcttacacgtttcttcgtttctcatatatatttcatactgtttgttcttcctttcacaaaactaaatcacttttaatttcagtaacaattattgagagctacacatacatgagaggtatggatattaaagttcagaaaggtgggtctgcaaaggaaaatgagacaggggtaagaaaaggtccttggacgttagaagaggacaccattctggttgattacattacaatacacggtgaaggtcactggaatacccttgcatcttctgcaggtttgaggagaagtggtaaaagttgtagattaaggtggttaaactacttgcgtcccgatttacgtcgtggaaatatcacacttcaagaacagatattgattcttgacctccactctcgctggggcaataggtggtcgaaaattgcacaacatctaccaggtagaacggacaatgaaataaaaaactattggagaacaagagtgatcaaacaagcaaagcaactcaaatgtgatgtaaacagcaaacagttcagagatgtattgcgtcacgtttggatgccccgattactcgaacaaattcaacccgcaccacaattccccgacacgaataatccaaacggatcacatatccttcttcaccaaaacacattgcaaagttcagtttcaggaatcagtggtatttcctcggactcttcatcagtagaattccaagttgcttcaaattcggaccaaaatgattcttcggagcttttgggccatgaaggttcaaaactatggtcaagtttcaataaccagcaggtttcagaacaggagaagagcggtgcttgtgatggtgactcgttgtggaacgatgagaacatgtggtttttgcaacaactttatgaagatgttgaaataaaatacaatttacttgcgtgacgctttgtgggaataatttaattcacagtagtgtgaaatattgaaaaaaaatggtatacggcactaagtagatcaataggtatatttgtcgcattaggggatgagtttttcctagacgtgttgctacaaatacataaatattgcacgcaccaagttttttttcttgtgcaattatgatcagttttactgagaaagctaacgtgtctttttaagttttatattaaaaagttgtgtaattattgtattgataaaaataacatgttgtattttaaattaaacattcctttagtgaacctttgaacatgtttatagaataaaaaaaaaaaactcgagggc

SEQ ID NO: 668 - DNA, 525 bp, Medicago sativa
atgggaagagctccttgttgtgagaaagtgggtttgaagaagggaagatggaccgcagaggaggatgaaattttgacccaatatgttaaggcaaatggggaaggttcttggaggtcattgcccaaaaatgcaggtttgcttagatgtggtaaaagttgtagattaagatggattaactatttgagagctgatctcaaaaggggaaatatttcttctgaagaggaaagtatcattatcaagatgcatgcttcttttggcaacaggtggtccttgattgcaagtcacttgccaggcagaacagacaacgagattaaaaactactggaactcacacttgagtagaaaagtttacagcttccgaggaacatcaacaacaaattataataatatcaaagagatagagattccatcagaagaaggaatcatagtggatacacctcccaaacgtaaaggtggtagaactagtcgatgggctatgaagaagaacatacgatatatatcccaaaaaccatcgaaactcatattc

SEQ ID NO: 669 - DNA, 723 bp, Medicago sativa
atgggtaggtcaccatgttgtgatgaaattggtgtaaagaaagggccatggacacaagaagaagatgagaagctgattgattatatcaacaaacatggccatggaaattggggaacactttcaaaacgtgctggtttgaataggcctgatatcaagagagggaaattcactgatgaagaagaaagagttatcatcaaccttcattcagttcttggaaacaaatggtcgaagattgcagctcatctaccaggacgaacagataacgagataaaaaattattggaacacaaacataaggaaaaagcttctcaagatgggaattgatcctgaaactcacaagccaagaactgattacaatcacctcatgagtctttcaaacttacttggcattggtggtgaagaatatgctatgaaccctagtttatactcttatggacaaagtgagtcttcaaagcaggatatttcaaaaggtgaatcaagtttacaagatcttgattatagcaaaatgagaagcatttcatgtgtaaatcaagaagaaaatctacttcctgctttggttgcttcctctcctagaattggaatcttcaatcaaatcgaaaatgaccgcaacaaagctcaaatgtccatcgatcactcaccttcaaatgcaatctttgatgattgggagaagttccttgacgatgaatcaagtggtggttcctactggaaagagcttttagagtaa

SEQ ID NO: 670 - DNA, 501 bp, Medicago sativa
gtttgtgatttgaaaatgagtagggctctagggttgaagaaaggaccatggacgccaaaagaagacaagaagcttatagcatatgttactcaacatggccatagaaactggcattctttgccctctagagcagttcttagaagatgtggaaagagttgcagactgaggtggattaactacatgattccagatataaaacgaggaaacttcagctcagaagaagatcacaatattattcagcttcatgcacttctcgggaacaaatggtccacaatagcagctctcctgccaaggagaacagataatgaaataaagaatcattggaacattaacatcaagaaaagactcatcagaatggggatagatcccaccactcacaaaccaaaatccaacaacaacaacgataatgataatactgctatcaaacacgtgtctcaatgggagcatgttagattggaagctgaagcaagagttgtaaaagagaagaagagaaaaagagag

SEQ ID NO: 671 - DNA, 1020 bp, Medicago sativa
atgggtcaccattcatgctgtaatcaacagaaggttaagagaggcctttggtcacctgaagaagatgagaaactcattagatacattactactcatggttatggttgctggagtgaagttcctgagaaagctgggcttcaaaggtgtggtaagagttgtaggttgagatggataaattatttaaggcctgatattagaagaggaaggtttacacctgaggaggagaagttaattataagccttcatggggttgttggtaacagatgggctcacattgcaagtcacttgcctggtagaacagacaatgaaataaaaaactattggaattcatggatcaaaaagaaaattagaaagtcatcttcttctgctcctaatttatcaacaccaactattgatcatcatcatcctcagttgatcaattatagttccattaatcaactagataattactttaccaaccaagaaaatgtaacaacaaaagaaaccttattttcatcaacatgtcctttatttatgtttgacacaagttcactgcatgaaacaacagcaacagacaccaatgtaataagaccagaagtactattccatcatgattctgtgagtttgagttctgacacatggaacttgaatcaccatgatcatcatcaacatcatcaagttcagacacttcctcctcatccagctgcaatagcttttacaacaattcatgatactagtaattataatcttccaccattgatagagaataatgtggaaaacagcatggtgccaattgatcaagtgcaatcttgtaatatggatgaggaaggaggagagttattaacattggagtcattgcaattgcaaagacaagaagagttgaatgaatgggtggaaactcaacaacaatgtcctagctttattttcagctgggagagtgttgaaggacaaattggaggtgaagaacaagtactagtaccaaactcatcacatatgggaacacctaattcactttctccttttccttcttcactattatga

SEQ ID NO: 672 - DNA, 682 bp, Medicago sativa
  misc_feature (669)..(669): n is a, c, g, or t
gagatcataagaaagtgacccttgattgagtgatagaatcaagttgagggcaaacctacaagtataaataagcatcaaccactagaccaaaagatcattgccacataaattggaagacaaacaactttatccaacacacacacaaactttgaaacatttgattctacatgtattggcgtggagtgatggcaggccaaattggtcatggtatcatggaggaagaggtttggaggaaagggccatggactgctgaagaggataggttgttgattgactatgttagactgcatggtgaaggaagatggaactctgttgctcggcttacaggattgaaaaggaatggaaagagttgcagattgaggtgggtgaattatctaagaccagatctcaaaaggggtcaaataacaccacaagaagaaagcataatattagagcttcatgctaggtggggaaacaggtggtcaacaattgcaagaagtttaccaggaagaacagacaatgaaataaagaattactggaggactcatttcaagaaaaaagcaaaaaatccctttgatgctgccgaaaaggcgaaaaaccgattcctgagaaagcagttatttcaccagcagcagcaacagcaacaattgcaacagcagcagcagcaacaacaactgcaattcaacttanacatgaaaggtgt

SEQ ID NO: 673 - DNA, 1077 bp, Medicago sativa
atgggaagagcaccttgttgtgaaaagaataatggcctcaaaagaggaccatggacacaagaggaagaccaaaaacttatagattatattcaaaaacatggttatggcaactggagattactcccaaagaatgctggattacaaagatgtggaaagagttgtcgtctacgttggacaaactatctccgaccggatataaagagaggacgattctcttttgaagaagaagaaaccataattcagctgcatagcatacttggcaacaagtggtcttcaattgcttctaggctaccaggaagaacagacaatgaaatcaagaattattggaacactcacattaggaaaagactcttaagaatgggaattgatcctgtgacacataatccacgttttgatcttttggacctatcttctatcctaaattcatctctctatgcctctacctcatcatcacaaatgaacatccaaaggctaattggtacacaatcaatagtgaaccctgagattctaaagttggcttcatcactcttctcttctcaaaatggacaagagaatcaccaaattgatcacaaacaacaaattagctcacacatggatcaagaagcatgcaccatgttgttgaatccaccttttgataataattcaatgtctttcattcaaacacacttggagaatatatactcatcatttttacctgaatttggcttccaacaacatcatgaaaatgttcaattaaattatttgcattgcaatggaattgcttcaagtaatgtaacagaggattttgttcatcaattaccatgctataactacttaagttctgattatcatgcaaatgatttaaatgtggaccctcacatatcagaaacttcaacctttcattgcaataacaacaaccagaattttaatttcgcttcagttctatctacaccttcatcaagtcccacacagttgaattcaaattctgcgaatatgaatgaaagcagtagtactgaagatgagacagagagctatgttagcaataacatgtttgaatttcatatctcagatatcttaggtgtgaatgagttcatgtaa

SEQ ID NO: 674 - DNA, 426 bp, Medicago sativa
atggcacccagaaaagatggacctacaaaggaaacaatgaatagaggagcatggacccaagaggaagatcaaaagctagcacaatgcatccaaattcatggtgccaagaaatggaaaactgttgcaaacaattcaggtttgaataggtgtggaaagagttgcaggctaagatggttgaactatcttagacccaatatcaagagagggaacatttcagatgaagaagaggatttgattattaggcttcacaaacttcttggaaacaggtggtctttgatagcgggaagacttccagggcgaacagacaatgaaattaagaactattggaattctcatttgtgcaaaaaagccagtcacatagaggaaaaaccagaaaacttccactgcacaagaaactatagcccaagacaatgttgttggggataa

SEQ ID NO: 675 - DNA, 1077 bp, Medicago sativa
gttttgtcttggaacattaattcattgtgcaatattattatgggtaggtcaccatgttgtgatgaaattggtgtaaagaaagggccatggacacaagaagaagatgagaagctgattgattatatcaacaaacatggccatggaaattggggaacactttcaaaacgtgctggtttgaataggtgtgggaagagttgtaggttaaggtggacaaattatttgaggcctgatatcaagagagggaaattcactgatgaagaagaaagagttatcatcaaccttcattcagttcttggaaacaaatggtcgaagattgcagctcatctaccaggacgaacagataacgagataaaaaattattggaacacaaacataaggaaaaagcttctcaagatgggaattgatcctgaaactcacaagccaagaactgattacaatcacctcatgagtctttcaaacttacttggcatgtcaaatataggcaatacttttagcaacaaccctcttggtttacaaccagatattacccacctagccaaaatgcaattgttgcaaaatatgttgcaaattatgaacacaaataattcatttggtaacatgggaaattatccttataaccccttagggaatattaaccctagctttaatccattcaatttgtttttgaatggaacaaacacaattcaaactaatgagccattaggtttgagtggtggtgaagaatatgctatgaaccctagtttatactcttatggacaaagtgagtcttcaaagcaggatatttcaaaaggtgaatcaagtttacaagatcttgattatagcaaaatgagaagcatttcatgtgtaaatcaagaagaaaatctacttcctgctttggttgcttcctctcctagaattggaatcttcaatcaaatcgaaaatgaccgcaacaaagctcaaatgtccatcgatcactcaccttcaaatgcaatctttgatgattgggagaagttccttgacgatgaatcaagtggtggttcctactggaaagagcttttagacttgacatccacttctgcgtcacaaatttcgtggtag

SEQ ID NO: 676 - DNA, 793 bp, Medicago sativa
atggttagaagtcctaaggaggttaataaaggtgcttggtctcgtgaagaagatgatatcctctccaaatatgttgtcattcatggagaaggaaaatggcaaaaggttgcccaaaatgcaggtttaaagcggtgtggaaaaagttgtagacaaagatggttgaattatctcaaaccaggtataaagagaggccatatctctaccgacgaagaagacatgatcataagacttcatcgtcttcttggtaacagatggtctttgatagctaagagactaccaggacgaacagacaatgaaatcaagaactactggaatactaatctgtcaaagaagttacaaaaacagccaacatcatcatcatcattgccatcaccatcttctgtttcacttcgacacaatcatggcaaatgtggacatgtagcaccagaagctccaaagcctaggagactgaaggctgttcatcaatacaaaattttggaaaagaatagtggaagtgagtatgatcaaggaagtgatgaaacttctattgctgattttttcattgactttgatcatcaagatcaattgatggttggtgatgatgagtctaattcaaagattccacaaatggaagatcacaaggtgagttcaacaaatagtactcatagttcatcatcaccttctgatcattgtcatcttttagcagagaaatttgaccctcaagagatccttttggatgtggagcttaagaagatggcttcctttcttggacttgaaatgattgaagtgatttattccatgaggggaccaagag

SEQ ID NO: 677 - DNA, 621 bp, Medicago sativa
atggaatttaagcacattcctcccagccctttagattctgaacctaattgccatgtgtttcatcatgcatttggttatgattttgtcaacaacgactataaagtgattcgccaaggaacagttgttgataaaactggttatatatgggagatatatagtctaagaaacaactcttggagaaaacttgatgtcgatatgcaaaagtcgcctatgtgtgaaaaccaattgtacatagatggactctcacactggttgtgttatggtgaaacacataatgaaacacatttattgtcatttgattggagcaatgaggttttccttaccacacccataccttcagacatggatgataatagatttgattgtgaatttggtgtaaagaaatcatggattaagatcttcattttagggcccttaccttatcttgagtatcctattggagccggaaagaagggtgatatgttgttcagaaaaaaagacgacgacaactacggtgaactagtttggtttgatttaaatacccaaatgattgaagatcttggcattacaacagagagattttcttgtaagatagtaatacataaagaaagcattattccacttgaaggagcaaatatttaa

SEQ ID NO: 678 - DNA, 720 bp, Medicago sativa
atgatggatcaaaaatctgaattctatgggaaaaggagagttgtattgtggaatccaactaccaacgaattcaggctccttcctttgcctgagaaaaatcctgcatggaaacttttcgccgatcattatcaaattggttatgatcatattaaagatgattataagatgattcggtgcacacgttattctccaaaaatcgttcctatctatcatgtgccatctgaacacttgtgggagatgtatagcctaaacagtaactcttggaagaaaattgatgctgatgtgccacattcttactgtagcattgaacacgcatacttgaatggagtgtgtcattggttggataaaactgaaacagatgtctatttggtgtcgtttgacttctgcaaggaatcttttattacaacacccataccctcttacgtatatgatagtttggattttcatttggtccgaagacgcttgatggtattgaatggatctattgcttttatggtacatgatactgaggcttctacatttcacatttcaattttgggtgagctcggtgtaaaggaatcatggacgaagctattcgttgttggacccttaccttgccttggccattttgttggagcagggaagaagggcaatatactcctcaggaaaaaagacagtgaactagcctggtttgatttaattaccgggatgattggtgttacaacagagaggttttattaa

SEQ ID NO: 679 - DNA, 2243 bp, Medicago sativa
cactttatagttcatttcatatcatatgatatctttcctccttattgagtatggctatcgaaatggcaatgaccaccatgtcccacacacacaatcgcataacaacacatcctcaactattaacaacactttcatcttccacaacactttctcaccttaaacaaatccatgcacaaatcctccactccaacacaacccccgaaaacaccaacaccctcctttcaaaactcgctctttctatttgcaccctctcttcttcctcctcaagcctccactacgctctctccgttttctcccaaatcccaaacccacatacccatttctccaatcaactccttcgtcatctctctcgcagttccttccctgaaaagaccatttttctatatcataaccttagagctattaacgctttcgctcttgaccgctttagtttcccttcattgttgaaagctgtttctaaagtttctgcttttaatcatggcttggagattcatggtcttgcttcaaagcttggattcgttgacgacccttttattcaaaccgggttaattgcaatgtacgcgtcgtgccgccgcataatggatgcacggttactgtttgataaaatgtgtcacccggatgctgttgcttggaatatgataattgatgggtactgccagaatggtcattatgatgatgctttaaggctctttgaagatatgaggagctctgatatgaaacctgattctgttatcctttgtactgtgctttctgcttgtggccatgctggaaatttaagctatggcagaacaattcacgagtttgttaaggataatggttatgctattgactcacatttacagactgctctcattaacatgtatgcaaattgtggtgcaatggatttggctaggaaaatatatgacggactctcatcgaaacatttgatagtttcaactgcaatgctttctggttatgcaaaacttggaatggttaaggatgctcgtttcatatttgaccaaatgattgaaagggacttggtgtgttggagtgccatgatatctggttatgctgaaagtgatcagcctcaagaggctcttaaattgttcgatgaaatgctacagaagagatcagtgcctgatcagatcacaatgttgagtgtcatttctgcttgttctcatgttggcgcacttgctcaagcaaattggattcatacctatgtagatagaagtggttttggaagagctctatctgttaacaatgcactgattgatatgtatgccaaatgtgggaacttggtcaaagcaagagaggtatttgagaatatgcctagaaaaaatgtgatatcttggtccagtatgatcaatgcatttgcaatgcatgggaatgcagatagtgctataaaacttttccgtaggatgaaagaagtaaatattgaacccaatggtgttacatttataggcgtcctttatgcttgcggtcatgcgggtttagttgaggaaggtgagaaattattttcatccatgattaatgagcatggaatctctccgacccgtgagcactatggttgcatggttgacctgtattgtcgagccaatttcttgagaaaagctattgagcttatcgagacaatgccttttgcgccaaatgttatcatttggggatcccttatgtctgcttgtcaagttcacggggaggctgagttaggggaatttgctgccaaacggcttcttgagttagagcctgatcatgatggagcccttgtggttttgtcaaacatatatgccaaagaaaaaaggtggaatgatgttgggctgatcaggaaatcaatgagttataaaggtatctcaaaggagaaggcgtctagcaggattgaaataaacaatcaggtgcatatgtttatgatggctgatagatatcataaacagtcagatgagatatatgagaagttagatgaggtagtcagtaaattgaagttggtcggctacaaacctagtacttcaggcattttgattgatttagaagaggaagataaaaaagaattggttctatggcatagtgaaaagttagcagtttgctatgggctaattagtaggaggaatgaatcctgcattcgcattgttaaaaatcttagaatatgtgaggattgtcattcctttatgaagttggtctcgaaggtgtatcaaatagagattgttgtaagagataggactaggtttcaccattgtagtggtggtatttgttcttgtagagactactggtga

SEQ ID NO: 680 - DNA, 1521 bp, Medicago sativa
atgggtgcccctatatgtaattctttactagctgcacttgctggttgtaatattgataatgcacgtaaggtgtttgatgaaatgattgttaggggtgtacgttttagtacgttgggttttggtgtttttgtttggtgggtttgtaaggagggtgatatggggaaagtgttgggtttagtggatgaggttggcgaatgtggttttgagattaatggttcagttgtggcggttttgattgttcacggtttgtgtgaggttgggaaggtggatgaggcaatggtgatgttgggtgagttgagggagagagggtggaagcctgattttatggcgtattgggttgttgctaatgagtttaggaagatggggaatgtggttgttgagattaaggttttgaagatgaagaggaaattaggtgtggctcctagaagtggggattataaagggtttatatttgaattggtctcggagaagcgaattttggaagcgaagatgactggggaggttattgttggtggtaattttgttgttgaggatgatgtttttaatgtgttgattgaatctgtttcggacattgatcctgttggggcgatcgtgttttttaattatgttgttgagaaagagaggtttttgagtgtttcgagtttgaatagcttgagtaggaatttgtgtagggtgggtaaggtggatgaattgttggaggtgtttcgtgttttggattgtcgaaattacttcaaggatgtcgagggttacaatgtgatggtgtcgtggttgtgcgaagctgggagagtgaaagaaggctatgctgttcttcaggagatgaagaagaaagggttgaatcctgatgtctcgtcttataattatgtgatggaagcgtgttgtaaggaggatttactgcgccctgcgaggaagctctgggatgagatgtttgcgagtggatgttgtgggaacttgaaaacatataatgttttgattcacaagtttttggaggaggggctaattgaagaggctcggacgttgtttaatcgcatggtggacaagggagttgaacctgatagtgcgagttacacttttctcttacaagggttctgccgagaagataaacttgaagaagcttttgagctctatagcaggtctgtcagacaggatatcaccattgcaagagacattttgggctcatttatattgtcactctgcaagaaaggacatatgacagctgcttccaaattactctgcagtctcagtcatgatataggacgcccagaatcgcacgtggctttgttgaaatgtttggcagatgcaagagagattcaaactgctattgagcatttgaggtgggttcggcacaagtcaccttcaatgctaccagatatatgtaccggacttttagcttccatttctgttgctaaatgcccggagccgatattgcagtttcttcaaagaatgcaaggacaacaaccaactaagccttttccaactgagtgtaaaattgtgatcaacgatggaaatatctttgcaggttga

SEQ ID NO: 681 - DNA, 1550 bp, Oryza sativa
gggttacaaccgccgccgcagcctttttcccaatcggcgctagttttcgatccgccgccgtcggccggagcgaagccaagcccgcgcgaccaggtggctgctgctgtgtaacgacgctagctagcttagctgcggtacgtttacacataggtccgtccgtgtgcggctgccaccatggaaggaaacggctgcggcggaagcggggcgacaccacgtggtgtcgttgggatgcactgggctcccgtcgtcacctcgccgcctagcccgcagccgccgttcctcccgccggcgccatgcaggcccgacgtccagatgcaacagcaaggcgggctgacctgcctcaagctcgggaagcggccgtgcttctggggtggcgacggcgccggccaggtggcgcaggggagcggcggcggcggaggcggaggcggtggtggttccgcggatcaggggaagaggaaggagaaggcggcgacggcggtgccggtggtgccccgttgccaggtggaggggtgcgacattacgctccagggagtcaaggagtaccaccggcggcacaaggtgtgcgaggtgcacgccaaggccccgagggtcgtcgtgcacggcaccgagcagcgcttctgccagcaatgcagccggttccacgtgctcgcggagtttgacgacgccaagaagagctgccggcggcggctggccgggcacaacgagaggcggcggaggagcaacgccagcgaggccatggccaggggctctgcgcacccacacggtatgccggtgctgggacacggtttcccgccgtacggcctgccgacgtcgtcggctggtgctctctctcttctgtcatcggctagagccaccggcccatggctgatgccgacgcccgacatctccgcccgctcaagcgcggcgctcgacgagctcatcgccgagaaccgcgcggccctcctctcgtggcaattcttctccgaccgacagccgccaccagctggccgtccaacgggccgcagcccgggctccgaaacggccggtggctggcacgcgcacctgcaggcgcggccgccaccgcccggcgccggagggcagcacgagaatcagtcggggcacgtgacgctcgacctcatgcaggccaccaccgcggcaggaggcagcggcgcgccgttccggcccgtgccagcgaggccccccaaggagggcggcgacgccggctgcacctccgacgcgtggacgccgtcgcccatggagggcgcccgcgtggtctgagtgtccgacctgccagccgcgacgtcgccgcgcgtgcaccacggtccctagctcccgtgtcagctgggcgtgggaagcgatcgatcagtggtgggcgcgtgcgcacggctggagctctgtcccgacgccgcgcgcagccgtgcaatcaacttgagttcgttggacaatagtgtctcgtctcgtagcaatctatcccgatgtagcagtactggtgcagtggtggtggtggtgccactagctagcaatgttctattttttcgctctaaaaaaaaaaaaaaaaaaaaaaaaaaaaa

SEQ ID NO: 682 - DNA, 1541 bp, Oryza sativa
agctgtctgagagaagttttggcagggggccacctaaatgtccaggcggcggtgccggcgtgctcggtggaggggtgcgccgccgacctgtccaagtgcgtccgcgactaccaccggcggcacaaggtgtgcgaggcgcactccaagacggccgtcgtcaccgtcgccggccagcagcagcgcttctgccaacagtgcagcaggtttcatttgctcggggagttcgatgaggagaagaggagctgcaggaagcggctcgacgggcacaacaagcggcgtcggaagccgcagcctgatcctctcaaccccggcaaccttttcgccaatcaccacggagcggcaagattcacctcgtacccgcagatcttctcgacggcggcgtccatgtcgccgcaggagacgaagtggccggcgaacgtggtcaagacggaggccgccgacgtgttccaagagccgtactaccacgccctccacctcaacggcgccggcgcctccgcggccgtctccatcttccaccacggcggcaacaaggcgaggaagcaccacttccctttcctgacggccgaccacggcggcggcgccgccgcggcgtcgccgttgttcgggtgccagccgttcaccatcacgccttcctcggagagcaggagcagcagcagcagccggcacagcaacggcaagatgttcgcccacgacgggggtctggacaactgtgctctctctcttctgtcagacaaccccacacccacggcgcagatcaccatcccacagcctctcttcgccggcggcgggcagtacggcggcggcggcggcggcgacgtgtcgctcaccggcctgtcctacgtcagaatggccggcaaggacacgtccatcttggcaaaatctgccactaccactgctactactgctactactcctactaccacaagtgcacagctgcaataccatggctactaccaccaccatgtcagcgccgatcagggtagctccgatgctgcaatccaggctcttcctttctcatcgtggtagtggagattccgggttccgatttcgatctcagcgaggccctgttcttgagctgaattcctgatagatcagatgctagggagatggtaatgttgttcaacaaaatatgtcagtgataatagttgtattatcttggtgatactgaaaaatattcaccacgatatgcacattttccaactttgcctggtatttccagtttatgggaaatacccccaagccagcttatgattcacaattgcattattagaactagtgctattatttttggagggttattgacttgtactgtagtggtacagcttttgttgtgtgtacatttggctatccacttgattggtgtaggggctagttcagcaggaactagacataagttaactgtacttgaatagtcaaattagcctcaaaagctggaggattactgattaaaactaatcgtgtggctctgcttgtttttcacatgctgtacatcaacagagacccttgttggaagacagggactaaattaagggttttggacc

SEQ ID NO: 683 - DNA, 1341 bp, Oryza sativa
atggagatggccagtggaggaggcgccgccgccgccgccggcggcggagtaggcggcagcggcggcggtggtggtggaggggacgagcaccgccagctgcacggtctcaagttcggcaagaagatctacttcgaggacgccgccgcggcagcaggcggcggcggcactggcagtggcagtggcagcgcgagcgccgcgccgccgtcctcgtcttccaaggcggcgggtggtggacgcggcggagggggcaagaacaaggggaagggcgtggccgcggcggcgccaccgccgccgccgccgccgccgcggtgccaggtggaggggtgcggcgcggatctgagcgggatcaagaactactactgccgccacaaggtttttaaggtttatgagcacggccaccacattagatgcactgtcaagtgcttagcaatggccacggattggaaaaacatacaacttcaattcctacgtttttcctattcctatgtttttcctatcctgcgtttcaaaggggcccttaaggatgaagggaagttccacctgctgcctgaatttgaccaaggaaaacgcagctgccgcagacgccttgcaggtcataatgagcgccggaggaggccgcaaacccctttggcatcacgctacggtcgactagctgcatctgttggtgaagagcatcgcaggttcagaagctttacgttggatttctcctacccaagggttccaagcagcgtaaggaatgcatggccagcaattcaaccaggcgatcggatctccggtggtatccagtggcacaggaacgtagctcctcatggtcactctagtgcagtggcgggatatggtgccaacacatacagcggccaaggtagctcttcttcagggccaccggtgttcgctggcccaaatctccctccaggtggatgtctcgcaggggtcggtgccgccaccgactcgagctgtgctctctctcttctgtcaacccagccatgggatactactacccacagtgccgctgccagccacaaccaggctgcagccatgtccactaccaccagctttgatggcaatcctgtggcaccctccgccatggcgggtagctacatggcaccaagcccctggacaggttctcggggccatgagggtggtggtcggagcgtggcgcaccagctaccacatgaagtctcacttgatgaggtgcaccctggtcctagccatcatgcccacttctccggtgagcttgagcttgctctgcaggggaacggtccagccccagcaccacgcatcgatcctgggtccggcagcaccttcgaccaaaccagcaacacgatggattggtctctgtag

SEQ ID NO: 684 - DNA, 1730 bp, Oryza sativa
ctgcaggaattcggccaggacagctcaagcttacgcgggagctaagctgagctacagcgagcggcggcggcggccatggagtgggatctcaagatgccgccggcggcgagctgggagctagccgacgagctggagaacagcggcggcgggggtgtaccggcggcggtatcgtcgtcatcggctgcggttggtggcggcgtcaatgcggggggtggtggcaggcaggagtgctcggtcgacctcaagctcggcgggttgggggagttcggcggcggcggcgcgcagccgcgggtcgccgtggcgggcgagccggccaaggggaaggggccagcggccgccgccacgggagcagcagcagcagcgtcgtcggcgccggcgaagcggccgcgcggtgcggcggcggcggggcagcagcagtgcccgtcgtgcgcggtggacgggtgcaaggaggacctgagcaagtgccgcgactaccatcgccggcacaaggtgtgcgaggcccactccaagacccccctcgtcgtcgtctccggccgcgagatgcgcttctgccagcagtgcagcaggtttcacttgcttcaggagtttgatgaggccaagcgcagctgtagaaagcgactagatgggcacaaccgtcgccgcaggaagccacagccagatcccatgaactctgcaagttatcttgcaagccaacaaggggcaagattctcaccgttcgcgacgccgagaccggaggcaagctggacagggatgagcacgagggagagagagacatactacacgcaccaccaaatccctcttggcatcagcagcaggcaggcagcatttcgttggctccacctctgacggcggccgccgcttccctttcctccaggaaggcgagatcagcttcggcaacggcgccggcgccggcggcgtgccaatggatcaggcagcagctgctgctgctgcttcagtgtgccaggcacttctgaagacggtagctcctcctcctcctcctcatggcggcggcggcagcggcggcggcaagatgttctccgatggtgggttgacacaagtgctcgactccgattgtgctctctctcttctgtcagctccggcgaactccacggccatcgacgtcggcggtggccgggtggtcgtccagccgaccgagcacatccccattgcgcagcctctcatctctggccttcagttcggcggcggcggcggcagctcagcctggttcgcggcgcggccgcatcatcaggcggccaccggcgccgccgccaccgcccgtcgtcgtctcgacggccggtttctcctgcccggtggtggagagcgagcagctgaacacagtcctgagctccaatgacaatgagatgaactacaatgggatgtttcacgtcggcggcgaaggctcatcggatggcacgtcgtcgtctctgccgttctcatggcagtagttttttcagtaactgtatgttgctgccttagtttcagtagagttggttcttcatttcttttcagtgatcaaattattgtttctgtttcttttctgccatggtaagttccttttttttttcttcttcttgccttcatttgagttaattacagcattgatttgtgtgaacaaaattcatcataaatcagttcctcgcgagatcattggtctcaacatgatggtgccaagtgagaactgcagtattgtgcagttttcagttttgagtctaagttgtataaacttgcag

SEQ ID NO: 685 - DNA, 1544 bp, Oryza sativa
gaatgacttcttcttcctcctcctctccacagtccacactgttcatctcctcctcccctccctcccaattcgattcccaaatcccaaaattgaccacccaaatccgcgccaatccatggattggatgcctcctccgaagcccacctcgccgcgctcccctcccctcctctgggactgggccgacgccgccgtgccgggctcctcctccggcgaggtatccgccgccgccgccgccgccgcggctcatccgggaaggcggcggaaggagaagcgaggcagggcggaggaaggaggaggtggtggtggggaggtgaggtgccaggtggaagggtgcggggtggagctcgtcggcgtcaaggactaccaccggaagcaccgcgtgtgcgaggcccactccaagttcccccgcgtcgtcgtcgccggccaggagcgccgcttctgccagcagtgcagccggttccatgcgctctcggagtttgatcagaagaagaggagctgcaggagacgcctgtatgaccacaacgctcgtcggcggaagccccagaccgacgtgttctcctatgcatcggcaaggccgccgtcgtcattattatttgatgataaccgacaaataagttttgtctggaacaaagctccactcagccatgtaaggcctttcgcaatttctccatgggaaagctcatctgaagttgggacaactgatggacatatttatttggataaatctcacatatccaaatctctcccagcatttaacaccgacatagatgagctcttaccaatgaaagacttctctgcagccactatttggatgttcttcggtgtcctttttatccgaactgcgcaggagagctgcatgtcatttcattaaggagaaaacaatgtacatattttgatggaagaatgaccattattccattttgcaggtccggacgcatctttaactgcttcaaaatttgatggagcaccggatcttcagcgtgctctctctcttctgtcatctagttcttgtggattacctgatcctgtacagcaagcatctcgcgtcatccaattcacaggcgccagccaaaacaaccgggaacttcctccacttaatggagggaattctgcttcagcatcatgtgccaatgtacaaactatagcacaaccggctcagctggttcgttttaccatgaatgctagcagcaatgcttgtcagtccaatttcttcggtttaaaccagataaactaaaggcctggactgagagcccgtcgtcgatttcgaccaatatccaccaaggtggccttgagaagatacaagaattgcttctatcaactatcagagtgcaaacaatgtcacagttaatgttgtcatcataaataccggtattggtctcccctgaactaaaatcgaacggagtgatggcttgcttgtgttttcgataatcgttatgcagttctaattttttttctattgttttctgccaatgtaccgattttcaaactgtgggtcttgtcatttatacttgtacaacctaatgtcaaaatgtcatgtatctttg

SEQ ID NO: 686 - DNA, 2047 bp, Oryza sativa
gaatggcaccaatgatcaaatcaagcaaagcaccactgctgctgcaaagaacaccagatagatcaaactctctctctctctggtgttgctgttagttggtagttttggtactacttggtactctgggaagaagaaagagattattatagcagaaaagcagcaccatggcatagctccaggcagcaaaaccaggtagaatacaacggggataacgattctctctcagctaaaggagatttggaaagggtttaaatagcgggtggttgtgccccgggctgcaggaattcggcacgaggggttgatgctgtcgtcttttaggtcggggaaacaagtgggataggatctctctcaagtcgaggttgtgctatgcatggtcatgctgattgagggcaagatttgcagggagaggaaggatccactgtgtttcttttctgggagaaaggaaagttgagatttgcaatatatacaagtgtgagcagcagcagttgagatccttaattcagccatggcttcttttgggatgaactggaatcagaagagccctgtgttttgggactgggaaaatccagcgcctttcggtccgaatacaatggaaaatcccaagagcatacctcaccctgaaccaagaggtgtagttgtcgcggccgcaaatcatggatccaccaattcatccggtggcacgttcacttctagctcggagctagccaatggttcatcgaagagctccttgtcagcgtcgttcgattcctcatccaagctggggaacagcttagagttcaggtttgcttctgtcaaagggcatggcaagaacatgtgcaaggatggcgaggccggtagagttgaagactcgggcacttctccagctgtggcagttagccatggtgagccggtaataggactcaagttagggaagagaacttactttgaaaatgtttgtggagggcagaatgtcaagagctcctctgcagcttcaggtgtgacttgtccatctactgtggtcaagaagatgaaggtgtctcagcagagcacacaaagctcatactgccaagttgaaggctgcaaagtcgatctgtcctccgcaagagaataccatcgcaagcacaaagtttgtgaagctcattctaaggcaccaaaggttattgtttctggtctggagcgccgtttttgccaacagtgtagtcggtttcatggtttagctgaatttgaccagaaaaagaaaagttgccgcaggcgtctatctgatcataatgcacgaagaaggaaaccgcaacaagaggcaatttcatttggttcatcaaggctcgccacgatgttttacgatgcaaggcagcagacagatatttactttggccaatctccttttggccaagtgagaagcaatgcaatttcttcatgtgacaacctgggaggcttcaaatttacagaagcaaaactcccctggatgaagccaatgaaaactataggccttgaggatctgaatttctctaccctgcagatgccaggcaatgttgtgtcgcatacggtgcatcatcatgattttgatgggctcataccattcaagggaaacaccccgaaggtcctcaaccaagcttgctttatggacaagctagaaccacaaattgtttctcaaaaaaacaaaaacaaaaacagagaggctagatccaccaattatctgttacaagctttttggacttcctgccttggtgtggatccagcctgtgccgtcgtgtcctccaactcgaatggagccccggatcttcggcgtgctctctctcttctgtcaagcgattcctggggcccggccgacgttcaggccggctcccaggtgcatcccggtggagtgatgccgcccctcgccgttgccgccgccaccgtcaccgccccgacgaaccctgtcagtgtgatgcatgctctgcacccgtccaccggaggaggaggattctggcaagacggcgacgacccgcctccgctcgatcatgcctcgcaggctcaggcgttcatgcatcctggcaatggcagcagctccggctatggccatctgcactga

SEQ ID NO: 687 - DNA, 981 bp, Oryza sativa
atggattggatgcctcctccgaagcccacctcgccgcgctcccctcccctcctctgggactgggccgacgccgccgtgccgggctcctcctccggcgaggtatccgccgccgccgccgccgccgcggctcatccgggaaggcggcggaaggagaagcgaggcagggcggaggaaggaggaggtggtggtggggaggtgaggtgccaggtggaagggtgcggggtggagctcgtcggcgtcaaggactaccaccggaagcaccgcgtgtgcgaggcccactccaagttcccccgcgtcgtcgtcgccggccaggagcgccgcttctgccagcagtgcagccggttccatgcgctctcggagtttgatcagaagaagaggagctgcaggagacgcctgtatgaccacaacgctcgtcggcggaagccccagaccgacgtgttctcctatgcatcggcaaggccgccgtcgtcattattatttgatgataaccgacaaataagttttgtctggaacaaagctccactcagccatgtaaggcctttcgcaatttctccatgggaaagctcatctgaagttgggacaactgatggacatatttatttggataaatctcacatatccaaatctctcccagcatttaacaccgacatagatgagctcttaccaatgaaaggtccggacgcatctttaactgcttcaaaatttgatggagcaccggatcttcagcgtgctctctctcttctgtcatctagttcttgtggattacctgatcctgtacagcaagcatctcgcgtcatccaattcacaggcgccagccaaaacaaccgggaacttcctccacttaatggagggaattctgcttcagcatcatgtgccaatgtacaaactatagcacaaccggctcagctggttcgttttaccatgaatgctagcagcaatgcttgtcagtccaatttcttcggtttaaaccagataaactaa

SEQ ID NO: 688 - DNA, 1496 bp, Oryza sativa
gattctataacccccacaccctcgccctcctccacccgcgtcgtctcctccctccccaagtctcctcctcctcctccgactccgatccacccccgggatcccgcccatggagtgcaaccccgtctcctcctccaccacctcctcctccctgctctgggactgggacgccaccgcctccgccgagccgccgccgccgcccgggaagcgcggcgggagggattcgtcgtcggcgtcggcgtcggcgaagcgtgggaggtcggcggcagcagcgggggatgcggcggcggtggcggcggaggcgccgcggtgccaggtggagggctgcgggctggagctgggaggctacaaggagtactaccgcaagcaccgcgtctgcgagccccacaccaagtgcctccgcgtcgtcgtcgccggccaggaccgccgcttctgccagcagtgcagcaggttccacgcgccttcggagtttgatcaggagaaacggagctgccggagacgactttctgatcataatgcccgtcgacggaaaccacagacagatgtgtttgcttttggctctggaacactaccgcgatcactgtttgatgataggcagcaaataagtttcgcatgggataataacgctccacttaaccatgcaaacaccacttcaagttcctcgtggacatctgacttacagctctcccaagtgatggacataagcaaaaggtcacgaaaagctggggcagacagtgcaaatatccgtttgtcaaatgctttgccaactctttgtcatgacacaaatgagctcttgccaataaaaggtgcagatgcatctgaaactgcttcaaaactagatggagcactagatgttcagcgtgctctctctcttctgtcagctagttcaaggggtttgactgaccccggacaccaaacatcttctatcatccaatttacgaattcgaaccaaaacagcacattgcccagtgtaccaagcgaaggaaactctaatgtacccttttgggttgatggacaacatcaagcggtagagcctcaggtgtttcagttcacaatggacaccggtaacactgtgtttccggatctagagcggatcaaaccttcctacgagtcttcaatgtttggtctgaaccagatacattgaagcctgcaatgatcaccagcacggtcgctgctagtatggatgaataagcacacgtcctggactatccaagatcgtccaagacttgccccaatctgccgagtgtcaatgctatatccgtgtgtttatttaccttcccataattcagataaaccttgtgaacgccaacatctaagtatcaagcgttcacaaagtgtgctagtttcaaccttatttctgtcaaaatgtaattgctgttgtgcaattctttgttcttcgtgttgtacaaattattcattgttcttggcgttgtacaatctactgcctaaccatttgtcagaatattagctctttcgggaaaaaaaaaaaaaaaaaaaaa

SEQ ID NO: 689 - DNA, 2720 bp, Oryza sativa
ggttcttctttcttagggttgctgctgctgctgcttttgaggagtggagtagttgaggccatagtagtagtagaagtagaagtaaactggtatagtcactactcactacactaccagttggtgtttgttctgagcattattggagtgtcagggaagggcatgtgcttttgttggttgctgtaggaggaggcagccatccactgggcctcactctcctcttgttgctgcctcctcctcttgttactgttcagtctcaggctctcaggctcacaggtggggttttgggagatactagttaggagggaaaggttgccatcttgtgtgtgttggatctttgtagaatacaacggggataacgattctctctcagctaaaggaggtgagattcttggtttcacatcaagtattattgttctttcttttacttccttcaaaatagtttctttgctttttatttcatatatggtttggtttatttatgctccccaacaagcaactggttcatgtgcggcacgagggaacaaataatgcagctctgattgacttggggtagtggctgtggtgatagattggaaagggtttaaatagcgggtggttgtggtgatgaatgggggccagccttgatggggttgatgctgtcgtcttttaggtcggggaaacaagtgggataggatctctctcaagtcgaggtgagtgagaactcagccaagaacaacaatggagtctctgttgctttagttctgccagccaattggtttcaactttcaacgctgctacttgttattcatcacctcctcggatcggtttgatttatgctcaaggttgtgctatgcatggtcatgctgattgagggcaagatttgcagggagaggaaggatccactgtgtttcttttctgggagaaaggaaagttgagatttgcaatatatacaagtgtgagcagcagcagttgagatccttaattcagccatggcttcttttgggatgaactggaatcagaagagccctgtgttttgggactgggaaaatccagcgcctttcggtccgaatacaatggaaaatcccaagagcatacctcaccctgaaccaagaggtgtagttgtcgcggccgcaaatcatggatccaccaattcatccggtggcacgttcacttctagctcggagctagccaatggttcatcgaagagctccttgtcagcgtcgttcgattcctcatccaagctggggaacagcttagagttcaggtttgcttctgtcaaagggcatggcaagaacatgtgcaaggatggcgaggccggtagagttgaagactcgggcacttctccagctgtggcagttagccatggtgagccggtaataggactcaagttagggaagagaacttactttgaaaatgtttgtggagggcagaatgtcaagagctcctctgcagcttcaggtgtgacttgtccatctactgtggtcaagaagatgaaggtgtctcagcagagcacacaaagctcatactgccaagttgaaggctgcaaagtcgatctgtcctccgcaagagaataccatcgcaagcacaaagtttgtgaagctcattctaaggcaccaaaggttattgtttctggtctggagcgccgtttttgccaacagtgtagtcggtttcatggtttagctgaatttgaccagaaaaagaaaagttgccgcaggcgtctatctgatcataatgcacgaagaaggaaaccgcaacaagaggcaatttcatttggttcatcaaggctcgccacgatgttttacgatgcaaggcagcagacagatatttactttggccaatctccttttggccaagtgagaagcaatgcaatttcttcatgtgacaacctgggaggcttcaaatttacagaagcaaaactcccctggatgaagccaatgaaaactataggccttgaggatctgaatttctctaccctgcagatgccaggcaatgttgtgtcgcatacggtgcatcatcatgattttgatgggctcataccattcaagggaaacaccccgaaggtcctcaaccaaggtgtggatccagcctgtgccgtcgtgtcctccaactcgaatggagccccggatcttcggcgtgctctctctcttctgtcaagcgattcctggggcccggccgacgttcaggccggctcccaggtgcatcccggtggagtgatgccgcccctcgccgttgccgccgccaccgtcaccgccccgacgaaccctgtcagtgtgatgcatgctctgcacccgtccaccggaggaggaggattctggcaagacggcgacgacccgcctccgctcgatcatgcctcgcaggctcaggcgttcatgcatcctggcaatggcagcagctccggctatggccatctgcactgattctgctgcatctatttggaacgggttgatgactggttactccgttcatgatcttaccctgtcagtgatggactctgaataatttgggggcgaattgtcctgcaaccccaggatttattatttctatttttgaaaccaaaccaccaggatatttgccattggatgagaagtgttcatgatcatgaaatgatctgttttgttccacagaatctgacatatctactactcgtcttgggaatgagctgagatcgattcgtgtgttgttcattcaggaaactattctaaattcttttggggataaaaaaaaaaaaaaaaaaaaaaaaa

SEQ ID NO: 690 - DNA, 1640 bp, Oryza sativa
gttgccgcacatatactcgtgctcgcgctcacgccgccgcccccgaaactccccgctccgccattgccgggggaggcgatctcccatctccatctcccatctcgcctcagcgaactccccttcacatcgcgtctcttccgtcgcagagagtggcggccggtgaccatttccggtgggagggcggaggttttgtcccggctccggcgacactccacactccgacagcccaccgctccgtcaccctgcatttttggtcaggatgcacgagagcgacagcagtcctgattctgacaggacacactggtatatgagcaatagcgatgacgagtcatttgttgataaagataaagattgcagaaggagcaccgtagccctgctgttgaagaaaggtccatggacatcttgggaggactccatcttagagaagtacatcaagaagcatggtgaaaggaactggaagcttgtgcagaagaacactggcctcttgaggtgtggcaagagttgccgtcttcggtggatgaaccatctgaggcctaacctaaagaagggggctttcagcaaggaagaagagaataaaattattaatcttcatcgcaaaatggggaataagtggtctcggatggctgctgatttgccagggcgtactgataatgaaataaagaactactggaacactcgaataaagaaatgcaagaacaatcgttcgcctttgtatcctgctaatgtatgcaacgatgctttgaatgaagatcaacatgagtctgctgaccccaacgttagggagaagctgaccaataatcatctagaagatactactagtatgtattctgcacccccaggttttcaggatgcttccatcagtaatatacttgataggagacttgcatcaaaagattatgactccatagaagatcaaagaaaccaaatagaagttgtagcaaaatatgagattccacttcctgtgttgaaaacaacgaacaatgacatatttccatcagcctctatctttgccaaccatggtatttcaaatggcaatctctctgctttgtccacaactgatgctttgcagatggagctccctttaatccaatttgatccaaacaaccagttcgtttactcaagggcttatgcgatgcacctaacaaactttgctttattaaatgatcaatcagaagaattactaaatgatactgatgtattgaactatgtggtgatgaaagaagagctttctggagggagtttgagtcctactattaatatgccatgtgaagcacataactccatggctgcctctaatgagctggtagtgccacaatatgaaggagatgctccacctcttcaagatgatttcacatcatatttctatttgaatgatactaatctatccatattcgaagacacaaatgaattgtttttggaaaacaagttggatactaaaggtaactgacgccagattgtcatgagttgctgctctcttggataaactcatcatgaaaccaagaattttattccatgaagctcgtgaacgagccagtcgttgctatctctcttattaggatttccagtttggatattgccgtactcctttacttttcttcatgtcgaaattaccatgcgtgctatgttgaatttcatctgct

SEQ ID NO: 691 - DNA, 4958 bp, Oryza sativa
ggaaaaatggggtgcccatgcggccctgcccaatagcgttgctgtacctttcagctttataatctcgcccctcgcgagagagactccccccatcctgcagactcgccccactctcttgctcagctcctcctcttcatccagtcctcaaaactctctctgatctctctctcttgctgaaaattctccgcacactccggtgggcttaagcggtggcggcgtctcgcctgggtgggcgagatccctctcttgctcgtccgcaaggtcgctccccctgcgagtccaatctactgacgagctgggaggagcaaaggagggggcaattggagctccgctcggttccaattcagccccaattttgagccccccggctgcggggttcggccagttgagacgccatgtatcgggtgaagagcgagagcgactgcgagatgatccatcaggagcagatggactcgccggtggccgacgacggcagcagcggggggtcgccgcaccgcggcggcgggcccccgctgaagaaggggccatggacgtcggcggaggacgccatcctggtggactacgtgaagaagcacggcgaggggaactggaacgcggtgcagaagaacaccgggctgttccggtgcggcaagagctgccgcctccggtgggcgaaccacctgaggcccaacctcaagaagggggccttcaccgccgaggaggagaggctcatcatccagctccactccaagatggggaacaagtgggctcggatggccgctcatttgccagggcgcactgataatgaaataaagaattactggaatactcgaataaagagatgccagcgagctggcctacccatctatcctaccagcgtatgcaatcaatcctcaaatgaagatcagcagtgctccagtgattttgactgtggcgagaatttgtcaaacgatcttctgaatgcaaatggtctttacctaccagattttacctgtgacaatttcattgctaattcagaggctttaccttatgcaccacatctttcagccgtttctataagcaatctccttggccagagctttgcatcaaaaagctgtagcttcatggatcaggtaaaccagacagggatgctaaaacagtctgatggtgtgcttcctggattgagcgataccatcaacggtgtgatttcctcggtggatcaattctcaaatgactctgagaagctcaagcaggctgtgggttttgactatctccatgaagccaactctaccagcaagattattgcacctttcgggggtgcacttaatggcagccatgcctttttaaatggcaatttctctgcttctaggcccacaagtggtcctttgaagatggagctcccttcactccaagatactgaatctgatccaaacagctggctcaagtacactgtagctcctgcgttgcagcctactgagttagttgatccctacctgcagtctccagcagcaaccccttcagtgaaatcagagtgcgcgtcgccaaggaatagtggccttttggaagagttgattcatgaagctcagaccctaagatccgggaagaaccaacagacatctgtgataagttctagttcttctgtcggtacgccatgtaatactacggttcttagcccagagtttgatatgtgtcaggaatactgggaagaacaacatcctggtccattcctcaatgactgtgctcctttcagtggcaattcattcactgaatccacccctcctgttagcgctgcatcgcctgacatctttcagctctccaaagtttccccagcacaaagcacttcaatgggatctggagagcaagtaatggggcctaaatatgaacctggggacacttcacctcatcctgaaaacttcaggccagatgcattgttttctgggaatacagctgatccatcagttttcaacaatgccatagcaatgcttctgggcaatgacttgagtatcgattgcagacctgttcttggcgacggtatcatgttcaattcttcctcgtggagcaacatgccacacgcctgtgaaatcctgcaaacctgtgtcaccagcggcagcgatgacgcaaggatcggccaggtgtcaggccatacagagataggagttgtgatactgcaacaggctgagagttcttctcctgatgcttccatgactgacattgcacctattcttgatgagattgacccgctcttgggtgcaagctctactcatcctgatacaattccaaaggatgattcggacactgattcacatgtttcctcacaggatcatcaaactgatgatgatagtaatgatgaaactgacaataatgatgctaaagagaatggtgaggaaaagaataaagaacaaggaaaggaagctgcatttatttggacagcagatgatgaaaaaaatctgatggatcttggatattctgagatggaaagaaaccgcaggttggagcttttgatggccagacgaagatccaggaagaacataaggtttgaaatcgacaatgacttgataggtattgataataatgatggtgggaggggtgttgacgacttgtctcgcttccatgtacaagtaccacatatttcagttccaaggaggaatccgtttgatcttccttatgattcagaagaagcggcaattcctggctcagcaccctcagttctgcatacaaggaaaaacccattcgatcttcctcttgatcagtccaatgatggtgatgtttctgcagataataatgaggaccacaaggacctcgatgaaaaagatttgcccaatgagcatgggtctccagctctgcagagacaggatagcgaccttgcggatgttggaagtgaatgctcggatggcatcaactccgtggatgttgaattagacaacagtgacattgatgatcgtgagattgctctacaacactttgtctttgaaagatcacaggaaagagaagcatatctttcctcaacaaaaggaaagggtcctgaagatgattacctgctcagttcagttgggaactccaagacacttcatccagtagctgacctgtttagctgggaagatggaaatggtgaaagcagccttggtgttaactcttcccataacatgtcagttgaattctcggactgggtttcatcccccaagccaattgcagagcatgattcaggaccagagaaccttcaggagtttcttaatactgaagttgcatcaagttcaaagacaattgttctaggcgcaagaaatccagctgaaaataatggaaatgttgattccatatcctattcaaacaatgaaatgccttcagataacttgggtcatgggtccatggagttcccatctgaattttgtaatgaatcactgccagtaatatctagggacttgcaccctatccctgaagagagggttgtcgagaacttcaatgtgcaagaaaagcatgaagcagtaatatttaccgattcagatgctgccttgactgggtttcatgtaattgaggagcactttgaagttggatgtgatgtaagcccgagttctgaagttgttccgtcatgccttcaagcaagtgattccatccaatctcgattagttgagaataaagaggtatcaaatccattcatttccatcgcttctgaaaccaacaaggtggatatgattgatttgaaggaagaaacagctgcaggatatccacttgattctgatgatgatgctgataaaatctatcctgagcccatggaggacaatgtaattgatgaaagtttcctatcagaactggatgcggtaggagatttccgggtagaagcaacaagatcggaccagcagatgcctgatgttgactcccatattgataataacacttccaatggtgttgcagagagctccttgattagccctcagatttcaagtaacatattttcaaatatgaaatatgccagtatgctcgaacatgaggagaattctccattggttgatgacctaaatggcaccggtcctgaatttggttggtcattaggagcatcttatgatgaccctgagcagactgtctacaatccgaggcgacggattcttggagcaagtcgttttgaagaaactaacacagagatgaagccactatttgatgagacagaagcatcttttgtcaatgcaccaatagaagcaaacttggtagttggaccaagtaaagtggatgttgctaatgagtctgagttaactaaaactgatacaaacatgatcgttcttgatgccaattctctggaggatatagagacggcctttaaacaagcaagcaatggcgttgttgagtccaccgtggacaatgaaaccccacaggtttctggtgttgatattgacccagaatccatagagagttctgaacaattggatgtcattgatgcaaaatccgtcgacgacatatatgctgctttgaaggagcacacaactgctgctatgaacagttccttcgaagaaaacgaagacaagcatggatgcggtgatactgtaaaattcaccatgcatgatgagcttccagaaggaacacatattgaaggtaacacagttggagatggtaaagagcctgaaccaatggggattacaagcagcatggatgtcattgatgcaaaatccatcgatgacatatatgctgctttgaagaagcagtcaagtgctgctgcgaatagttccttcgaacaaaacgaaggcaagaacggatgtggtgatactgtaacattcaccacgcacgatgagcttccggaaggaacacacattgaagatagggataatacagttgaagatggtaaagagcctgaaccgattgggactacaagcagcatggacactattgaggtgaaaacaattgatgacatagacgcagtgttcaagaagctctctgatggcggtaccaagagtgctgcccaggcagtggattgcgagaatacttgtgaagcaagtgatgaaagtgaacagcactga

SEQ ID NO: 692 - DNA, 1077 bp, Oryza sativa
atgcagcgagagtgcatcgtgtcgggaccgatcgacgggtcgatctctgcgacgggcgacggcgcgcgtcgaggcgttggcggcatgcgcggtcatcgctcacgcgtccgcggggatggtggcctgcggatgcacaggagcggcagcgatcctgattctgacaaggcgcactggtatatgagcaatagcgatgacgagtcatttgttgataaagataaagattgcagaaggggcaccgtagccccgctgctgaagaaaggcccatggacatcatgggagaactccatcttagagaagtacattaagaagcatggtgaaaggaattggaagcttgtgcagaagaacactggcctcttgagtttttgcatcacaaggcgtactgataatgaaataaagaactactggaacactcgaataaagaaatgcaagaacaatcgttggcttttatatcctgctaatgtatgcaacgatgctttgaatgaagatcaatatgggtctgttgaccccagtgttagggagaagctaaccaataatcaactagaagatactactagtatgtattctgcaccccagttttcatatgcttccatcagtaatatacttgataggagacttgcatcaaaagattatgactccatagaagatcaaagaaaccgaatagaagttgcagcagaatatgagatttcacttcctgtgttgaaaacaaccaacaatgacatatttccatcagcctctatctttgccaaccatggcatttcaaatggcaatctctctgctttgtccacaactgatgctttgcagatggagctccctttaatccaatttgatccaaacaaccagttcatttactcaagggattatgcgacgcacctaacaaacttagctttattaaatgatcaagcagaagaattactaaatcatattgatgtattgaactatgtggtgatgaaaaaagagctttctggagggagtttgagtcccactattaatatgccatgtaaagcaacggcatattcttcagaactccctttatgcaagggatatcgggaacaagatcttgatttttacacacaatag

SEQ ID NO: 693 - DNA, 1855 bp, Oryza sativa
atggaagagatgatcaagccggcaccggcaccggcgtcgtcggaggaggagaaggaggtggtggctactgctgctactggagaaaggaggcatgaggaggcgacggccgggagagaggagcaggaagaggaggaggaggaggaggaggcgccggtggtgctgaagaaggggccgtggaccacggcggaggacgccgtgctggtgcagcacgtccggcagcacggcgaggggaactggaacgcggtgcagcggatgaccgggctgctccgctgcggcaagagctgccgcctccggtggaccaaccacctccgccccaacctcaagaagggttccttctcccccgacgaggagctcctcatcgcgcagctccacgcccagctcggcaacaagtgggcgcgcatggcctcccatctgccggggaggacggacaacgagatcaagaactactggaacacgaggaccaagcggcgccagcgcgccggcctgccggtgtacccgccggatgtgcagctccacctcgccttcgccaagcgctgccgctacgacgacttctcctcgccgctgtcgtcgccgcagcaatccgcggggagcaatgtcctctctatggacgcagccgatgccgccggcgccgcctcgtccgggtacaccagcgcgcgcccgccgccgctcgacctcgccggccagcttgccatggggagccggccggttcagctcctcgccgcgacgccgttctccgcgccttcgtccccgtggggtaagccgttcgctcggaacgcgcagttcttccagttcccgcactcgtcgcccgtgtcgccgacgacgccgaccgggccggtgcaggtgcacccggtcacgccggagctctcgttgggctacggccttcacgccggcgaccgggccagactcccgcctgtctcgccgtccccgggtgccagagccgagctcccttcaagccaattgcgcccgtcgatggcgcctaccacagccgccgccgccgccaccggcggcttggtcggcggagcgctgcaggatcacccaaacgcggcgagcctcgaggccatgctgcaggagctgcacgacgccatcaagatcgaaccgccggcgccgccggaaaacagaggaacggaagaagaaggcggcggcggcggcggcaatctgcgcggcttccttcatgagcaaatttttgacaaattgatgcccatcaagtctgaagatttttgcatcgtggggttgcattctgtactaatttcacttcaatttccaggtgacggcaaaccggaggtagagctcaaggacgacatcgagacactcttcgaccttatcataccggcgacgttcccggcggcggcgccggagcccgccgccgccgcgacggccgcctccgccgcgcccaaccactccagctccgtctcgcagcacagcagcgacgaccaggaccactccaacggcgccgacgtcctcgacctgcccatcctcaccggcggcggaggcggctcgtcggagcaggacgactggagcctcgacggcgccgcctgccagtgggacaacatctccggcggcatctgctgacatgaatttcgatgatcaacgcctgcgtcttgaaaccttctgtgatccccagagaccgctcacagaagagctcttttttttgtttcccttttgcgaacatttttcttggccttcttttttttttcaatgtacctggggttaattaggttgtatcgatcgtgactgagccaagtgccaatcttcgatgccccccgtgaggcttttaacttcgtttttttttaattaccaatgactcggtctgagctgatccatccaagtttttatctagtatctctggtaaaaaaaa

SEQ ID NO: 694 - DNA, 2410 bp, Oryza sativa
atgccgcgcgccgccgcgccgcacggcggtctttgcctctgccgtctccgtctccgatcccgtcgcgcgcgcgtcgtgttgaagttgcagcagccagcaatgcagcctgactcgactgatcgcctcgcgggccggcacgcagggtgcagcgagcgagcggccgacattttatgtaagcttcatcggacaaaacaaatgatcgttttcaggaagttcaccactaaatctaagaaacactcaatgcagtcctgtaaaccaaggttacacaggtggatcgtgctcaatccgaatggcaaaccctcaccatatactcttactttccaatttccttcgcgaacaccgacgcttgcacgcacacctcgtgaagcccgttgcaaagatttcacccacacggtatccatccaccgtatgccatctcgtatccaacttcgtcacgagtctactactctacttcgctctccgccgccgccgccgccgccgccgccgcccacctcgtctcgacgccggatgaggatggagggttcgtcgccgatggaggaggaggaggaggcggcgaggctggcgggctcgcagggggagtcgccggcgatgctgcacccgaacggagacggagacggcgacggcggcgatgatgagggtgacgccagcggcggcgaagaggagcagggcggtgtggctagggcgggggttcgtcgccgcggcggcggcggccgtgtgcgcgtgcgtggcaggattccgctgaagaaggggccgtggacgcccgacgaggacaagcggctgcgggagtacgtggaggcgcacggcgaggggaactggaaccgggtgcagaggaacgcggggctgaaccgctgcggcaagagctgccgcctccgctgggcgaaccacctcaagcccgacctcaagaaggggcccttcagcaaggaagaggaggagatgatcatcaagctccatttatggctggggaacaagtgggctaagatggcaaactctttgccaggccgcacagataatgaaatcaagaacttctggaacactagatgtaagagaattcagagaactggtgaacctctatatccgaaggagtttaatcattttaagttgacagatctggaagtgatgaactgtgaaagccctgatgaatcacgtgccaagaaacgaacaaatgaggttttacagggaaatggtcaaagttacaaagaggtttttttcgataatttagactatagtagaccagaaaattatattcggccaaattgtgtgactccaaattctcttccagttgatgccacaagtccatttggtagtgccattgccacacaagatcagtcagtaccttttggtagtgccattgtcagtggacatccaattcttgatggcaacttctctacttctgggaccatacagaggcccatgaatgtagagctcccttcactccaatatcccaactatgactttaacaataataatgcatggtcatatcacgaccccttaggacatcctattgaccaggttgactttggctccctgagatcagaatatctctctccaaacaacaatggtctgctggatgcattggttcatggaggacatggacaaggggaacttgcaaattcccaaggatcttttgatgcttgttttcctcgtgttcaatgcaatcaagtgattcaatcgaatgctttctctctgagttcttcctttccaatcattggtgatgatctcctcgagaacagttgtcatgcttttgttggcatcaacaataatgcaagcagcctattccttgacagccaacctccacccttggtggaccctactttctggaggcacgatgtatcactagaaccgaatttgccagtttattgccagtttaacgaagaattgccgccctcaaatgagcagtttgccaaagatgcagatgacgctttcggtcatgggggtctttctgatgagaccaatctagctgctgcaggtcaaggcgatgaacatgaccttgaggacccctgggcgagcatgcccggtgcctgtgacatacctgattttccaagtgaatgacttgcatagagtttgtgcgtgttattgattttgatctcaaccagtgagagaaccaagaagatcctttttgcaataaccatgcctttcaagatcgtccaataagtttgtggctgcgtatgctattactatcttaccgtggagttgtgtgctatatgctttgctccccgaggaaatgtggcccttgaactgaatgttgccattgtttgtgtcggctacttattcgattcattaatgttacattgtttgctagaatatgctgaaattgtatattcgattcattggttttgattaatcaaagactattgtcgtcatgtggcaattggtacaacttgaagggaagtgaatgctctaattgcttggg

SEQ ID NO: 695 - DNA, 1955 bp, Oryza sativa
  misc_feature (772)..(774): n is a, c, g, or t
  misc_feature (782)..(782): n is a, c, g, or t
  misc_feature (793)..(793): n is a, c, g, or t
ttggtctttctcctcctcgccagggaaaggcccccccgccgccgccgtcgtcgttccagctatagctttccccgccggcggtggcgatcgatcgatcctctcctcgtcggttgattagggtcaagaattcttccctctcccagcttggttgaatttcttggtttgatcaaggggaggaattaattgagaggtgaattagttcgccggagtttgtttctctctctctctcctcttctctgagctgagagggggaggagagaatcaagtgacgagttatagtatggcgaggagcggcggcggcaatggtgggggagaaggtggcggcggcggcggcaatggcggtggcgggggagggttgaagaaggggccgtggacgcaggcggaggacaagctgctggtggaccacgtgcggcggcacggcgaggggaactggaacgccgtgcggcgggagaccgggctgcagcgctgcggcaagagctgccgcctccggtgggccaaccacctccgccccgacctccgcaaggggcccttctcccccgacgaggagcgcctcatcctccgcctccatggcctcctcggcaacaagtgggctcgcatctcctcctacctgcatgggaggacggacaacgagatcaagaactactggaacacgcggctcaagcggcgggtgcgcgccggcttgacgccgtacccgccggagatcgagagggagatcgcgcacctccgcgcgcagaatctcaacctgtccgccgaaggcggcggcggcggcggnnntatgctgnctttcgcgttncttctttacccgagcatcccgttcgccttgcagcaggcgccggtggtggcgccgtcgccgtcggcgtcgcaggcgaattcgccgccgctgatcaaccagaattacccgctcctgaaccagatgcaggggctgcagcttctccacctcgccaaccaccagcaggcgccgccgccgcagcagcagcagcagcagcagccggcgttccaccaccaccacgacggcggcggcggcggcgggttcgtctcgtcggggctcccgccgctgccgaacagaccgcgcgagctcccttcgaaccaattcgagacggcgacgagcggcggcggcggcggctgcgacgcgctgctcgagtcgctgctgctcggcgacgaccacctcctgccgcggcccaaccccgccatgctcagggtgggctccatgcccgagctgatgtaccgcgagcctagctcaagccacgtgctccatggcggcggcggcggcggaggcgccagcgacagtgacgtcacctcgcagtatcctccgggagaagaggacccgcattatggcgggagatgggacttcatcttcgaggacgtgaaacccaagaggaaggcggcgagcgcggtggaggagatctccggcatgttcggcatcgccccgggctccatcccgggggaatggttcaaccccggcggcgtcggcagcgccgccgccgccgccggcgggtcgtcggctccgtctccggggccgtcgtccgtcgtcaccaccgacgacgacttcaccctcgagatgcagcagatcatgtcgtcgctgccgctgcttcaacctgaagagcatcataactggaacgcataaagctttggaacagcaagatgagagatgatttggtagtgagagagagagagagactgtaaatcggttctgatgagcagtgagaaaaaatgttggttcttgttttttgttgtttgtactgggccttattgtcggatctgtcacgcgctctgccttttgaattgcaaactgtttttcgttattgctatcaagtaattaaaagggtttctcgtagttgatagtccttgtctaaatcagtgaagagattcaagaaaattcagctgatatattggaaatccactccagcaactgtggagtatgttccttgtccaaaaaaaaaaaaaaaaaaaaaaaa

SEQ ID NO: 696 - DNA, 2160 bp, Oryza sativa
atgtcggtgacgagagatcggacaaagagcccaggcgggcacccgactagcccggaagagatgataactttcgtggattccgcggcgaaggagcgggagcgggagagtgacaagtgcttggacccgcagctgtggcacgcctgcgccggcggcatggtccagatgccgccggtgagctccaaggtgtactacttcccgcaaggccacgccgagcacgcgcaggggcatggccccgtcgagttcccgggcgggcgcgtcccggcgctcgtgctctgccgcgtcgcgggcgtcaggttcatggccgatccggacaccgacgaggtgttcgccaagatccgcctcgtccccgtccgcgccaacgagcagggctacgccggtgacgccgacgacggcattggcgccgccgcggccgcggcggcgcaggaggagaagcccgcgtcgttcgccaagacgctcacgcagtccgacgccaacaacggcggggggttctccgtgccgcgctactgcgccgagaccatcttcccgcgtctcgactactccgccgatccccccgtccagaccgtcctcgccaaggacgtccatggcgtggtctggaagttccgccacatctaccgcggcacgccgaggcgccacctcctcaccacggggtggagcaccttcgtgaaccagaagaagctcgtcgccggcgactccatcgtgttcatgcgcaccgagaacggggatctctgcgtcggcatccgccgcgccaagaaagggggcgtgggaggcccggagttcctgccgccgccgccgccgccgccgccgacacctgccgccggcggcaattacggcgggttctccatgttcctgaggggcgacgacgacggcaacaagatggcggcggcggccaggggcaaggtcagagcccgtgtccggccagaggaggtcgtcgaggcggccaatctcgccgtgagcgggcaaccattcgaggtcgtctactacccgagggcgagcacgccggagttctgcgtgaaggccggggcggtcagagcggcgatgcggacgcagtggttcgccggcatgaggttcaagatggcattcgagacggaggactcatcaaggatcagctggttcatgggcactgtatcggccgtgcaggttgctgaccccattagatggcctaattcaccatggaggcttcttcaggtttcatgggatgaaccggacttgttacagaatgtgaagagggtgagcccatggttggttgagcttgtgtcaaacatgccggccatccaccttgctccattctcgcctccacggaagaagctttgcgtgccgttgtaccccgagcttcccatcgacggccaatttccgacaccgatgttccatggaaacccgctcgcccgtggggttggtcctatgtgctatttcccggatggcactcctgcaggcatacagggagccaggcatgctcaatttggtatatctttatcagatctccaccttaacaaactgcagtcgagtctatcgccccacggccttcaccagcttgatcacggcatgcagccgaggatcgccgctggtctaattatcggtcatccggctgctcgggatgatatctcatgcttgttgaccattggtagcccccagaacaacaagaaatcagatggcaagaaggcgccagcccagctgatgcttttcggaaaacccatactcacagagcagcagatatccttgggtgatgctgcttcggtggatgttaagaagagctcttctgatggtaatgctgaaaatacggtgaataagagtaactccgatgtttcaagcccgagaagtaatcagaatggcaccacagataatttgtcatgtggaggagttccattgtgccaagacaacaaggtacttgatgttgggctggaaacagggcactgcaaggtattcatgcagtcggaggatgtcgggcgcacacttgatctctctgttgttggttcatatgaggaattataccggcggcttgctgacatgttcggcatcgagaaagctgagctgatgagtcatgttttctaccgtgatgcggctggggcactcaagcacactggagatgaacctttcagcgagttcacgaagacggcgcgtaggctgaatatactaacagatacaagcggcgataacttagcgagg

SEQ ID NO: 697 - DNA, 2187 bp, Oryza sativa
atggtgattagtaggacattggtggtaaggggttttgatgaactttgggagacgattcggccggttttggtttcatcagatggtccagcttccatgagcaaaaatggactgttgcttgttgtttcggaggagttttggattggcaaggtttggtgggtgagcggtgatcgcatttgggggttggagatgaaggaggtgggggaggtggaggaggtgaggtgcttggacccgcagctatggcacgcgtgcgcgggcgggatggtgcagatgccggcgccgcgttcccgggtgtactacttcgcgcagggccacgccgagcacgccgacggcggaggcggggcggcggcggcggccgcggagctggggccgcgcgcgctcccgccgctcgtgctctgccgcgtcgaaggggtccagttcctggccgatcgggactccgacgaggtgtacgccaagatccgcctcgcgccggtcgcccccggggaggccgagttccgggagcccgacgagctctgcccgctcggcgccgccggcgacgcggcggagccgtcgccggagaagccgacctcgttcgccaagacgctcacgcagtccgacgccaacaacggcggcggcttctcggtgccccgctactgcgccgagaccatcttccccaagctggactacagggccgacccgccggtgcagacggtgctcgccaaggacgtccacggcgtggtctggaagttccgccacatctaccgcggcacgccgcgccggcatttgctcaccaccgggtggagcacgttcgtgaaccagaagaagctcgtcgcgggggactcgatcgtgttcctgcgcaccaggcacggggagctctgcgtcgggatacggcgggcgaagcggatggcgtgcggggggatggagtgcatgtcggggtggaacgcgccgggctatggcggcggcggcttctcggcgttcttaaaggaggaggagagtaagctgatgaagggccatggtggtggtgggtacatgaagggcaaggggaaggtgaggatggccgatgtcgtggaggccgctagcctcgcgtcgagcgggcagccgttcgaggtggcgtactacccgagggctagcaccccggattttgtcgtgaaggctgcgtcggtgcaggccgcaatgaggatccagtggtgctccgggatgaggttcaagatggcttttgagacagaggattcatcaaggattagctggtttatggggacaatatcttctgttcaggttgctgatcccaacagatggccgaattcgccgtggagacttcttcaggtgacatgggatgaaccggacctgttgcagaatgtgaaatgtgtcagcccatggcttgtggagcttgtgtcaagtattccaccaatccatttaggaccattttcgtcacctcgaaagaagttgcgggttcccccacatcctgacttcccatttgagggtcatcttctgaacccaattttccatgggaacccacttggtcctagcaacagcccactatgctgttacccggacaccgctcctgcaggcatacagggagccaggcatgctcaatttggtttaccactaacagaccaccagcttaacaagctgcaccttggtctgttacatagcggcagttttaacagacttgatgctattactccaccttcccggatatcaaagggctttgtggtcagtagtgcaccagcccatgacaatatctcttgtttgttgtcaatcagtacaccacaggtcgcagagaaatctgatgacagaaagacgacaccccatataatgctgtttggaaaggctatatttactgagcagcagataacttcaagcggatcaacagagacactctcccctggagttactggaaatagctcacctaatggcaatgcgcacaagacaggaaatgcatctgatggttctggttcatcaatttgcattggtttctcatctcaaggtcacgaggcttctgaccttggtttagaagctggtcactgcaaggtatttatggaatcggaggacgttggtcgcaccattgatttgtctgtctttgggtcatacgaagaactgtatggtcggctggctgacatgttcggaatcgagaaagaagaaatcataaaccatcttcatttccgtgacgcagctggtgtagtcaagcatccgggtgaggtaccattcagg

SEQ ID NO: 698 - DNA, 2088 bp, Oryza sativa
atggagctcgcggggccgacggaaggcgacggcggcgggtccgtggactcccagctgtgggcggcgtgcgcggggagcatgtcgtcggtgccgcccgtgggcgcggcggtgtactacttcccgcagggccacgcggagcaggcgagcgcggccgtggacctgtcgtccgcgcgcgtcccgccgctcgtgccgtgccgggttgtcgccgtgcggttcatggccgacgcggagagcgacgaggtcttcgccaagatacgcctcgtcccgctacgccccggcgacgcggtggtggacgtgggcgaggcggccgcggccgaggcgcggcgggaggaggagaatagtaggccgaggccgacgtcgttcgccaagacgctgacgcagtccgacgcgaacaacggcggggggttctccgtgccgcggttctgcgccgagaccatcttcccggagctggactacagcagcgagccgcccgtgcagtccgtctgcgccaaggacgtgcacggtgtggagtggacgttccggcacatctaccggggcaccccgcgccggcacctgctcaccacggggtggagtcccttcgtcaacaagaagcagctcacggccggcgactccatcgtgttcatgcgtgacgagggcgggaacatccacgtcgggctccgccgcgctaaacgcgggttctgcagcatcggcggcgacgacgagagcctctcctcgattcccgggtgggaccagtacaggggcttgatgcggcgcaatgcgaccgcgaccgcgaccggtgggagaaccccgcccaaggggaaggtcccgccggagaacgtgctcacggcggcgacgagggccaccaccgggcagccgttcgaggtgctgtactacccgcgggcgagcacgcccgagttctgcgtgagggcggccgcggtcaggacggccatggccgtgcagtggtgccccggcatgcggttcaagatggcgttcgagacagaggactcgtcgcggatcagctggttcatgggcactgtcgccggcgtccaggcctccgaccccgtccgttggccgcagtcgccatggcgtctccttcaggtgacctgggacgagccggagctcctacagaacgtaaagcgcgtgtgcccgtggctggtggagctcgtgtcgagcatgcccaacctccacctgccatccttctcgccgccgcgcaagaagccgcgcaacccgccttacgcggagctccccctcgagggccagatcttcaccggcccggtgttcccgcccaatccaatggcgcacgaccaccaccaccaccatggtttccctttcctccccttcccggacagtagtgctcaacctgcaggcatacagggagccaggcatgcgcagttcgcttcaccgttcccggagttccacatcggcaacctgcagccgaatctgatgctctacgccggcatccgcctcccgcccgccgatcgcgccgcccccgctcctcgcccgccgagaatcatcatcagcaccgacctgacgattggcagcccgggtaaacccgacgacgccgcgtgctctccctcatccggcggcaagaagatcgacgacaccaagccgcgggggtttctcctctttggacaggcaattctaaccgaggagcagatcaagaacggcaactccgatggtcgtccggcctcgccgaactgggacgccgagaaggcgcctaacacctcggaaggctccgactccggcgtcacccagggcagccccaccaagaacaccacgccgtcgtggagcctaccgtattttggaggcaacaacatcagccgcgcatccgagtacgagctgaatcccgggcagtgcaaggtgttcgtcgagtcggaaaccgtcggccggagcctcgatctctcggcgctgagctcgttcgaggagctgtacgcctgcctgtctgatatgttcagcattggcagcgatgaactgaggagccatctggtgtaccgcagccccgccggcgaagtcaagcacgccggcgacgagccattctgcgcgttcgtgaaatcggcgcgtaagcttaggatactgacagatgctggcagtgacaacctgggagattag

SEQ ID NO: 699 - DNA, 3224 bp, Oryza sativa
gagtgggtagtaggagaagtacttgcttaagctcctcttcttgccctggactcctcttctcctctctttctctctcctttcccctctctctctctctctatttagttcttttgcccccatgtcagctgcagtctgggggaatctgaggctgctgctcacctgagagactgaaaggaggcagaagcagcagcagcatcagcatcagcagcagagcagatagctgagctgcagagggggaggagagaagatagtagtggtagtagtagctgagctgtgtcaagattgcccttcaaattcatcatcttttgctcttgtgagaaaaggtgagtagtggtttctgggttgcgtctccctttttctgcaagatttctgagccaaaattctctcttttgctcgctttgttcccttttctttcttttctttttttcccttcttcctcctttctgctctgctggttggttggttctttctcctcccccagcctttttcagctatgagctctgattgatgatgacgatgatggcggctgtgcagctgaaaagcttcttcaccttgtggtagtggtaaaagctgtgggaaatttcatccataaagatcgccgtggcgctcgaattccgctgaattttgtttgtgctcgagctgatcggtggaggtgaaagatttttgcgtcgaagagatgataactttcgtggattccgcggcgaaggagcgggagcgggagagtgacaagtgcttggacccgcagctgtggcacgcctgcgccggcggcatggtccagatgccgccggtgagctccaaggtgtactacttcccgcaaggccacgccgagcacgcgcaggggcatggccccgtcgagttcccgggcgggcgcgtcccggcgctcgtgctctgccgcgtcgcgggcgtcaggttcatggccgatccggacaccgacgaggtgttcgccaagatccgcctcgtccccgtccgcgccaacgagcagggctacgccggtgacgccgacgacggcattggcgccgccgcggccgcggcggcgcaggaggagaagcccgcgtcgttcgccaagacgctcacgcagtccgacgccaacaacggcggggggttctccgtgccgcgctactgcgccgagaccatcttcccgcgtctcgactactccgccgatccccccgtccagaccgtcctcgccaaggacgtccatggcgtggtctggaagttccgccacatctaccgcggcacgccgaggcgccacctcctcaccacggggtggagcaccttcgtgaaccagaagaagctcgtcgccggcgactccatcgtgttcatgcgcaccgagaacggggatctctgcgtcggcatccgccgcgccaagaaagggggcgtgggaggcccggagttcctgccgccgccgccgccgccgccgccgacacctgccgccggcggcaattacggcgggttctccatgttcctgaggggcgacgacgacggcaacaagatggcggcggcggccaggggcaaggtcagagcccgtgtccggccagaggaggtcgtcgaggcggccaatctcgccgtgagcgggcaaccattcgaggtcgtctactacccgagggcgagcacgccggagttctgcgtgaaggccggggcggtcagagcggcgatgcggacgcagtggttcgccggcatgaggttcaagatggcattcgagacggaggactcatcaaggatcagctggttcatgggcactgtatcggccgtgcaggttgctgaccccattagatggcctaattcaccatggaggcttcttcaggtttcatgggatgaaccggacttgttacagaatgtgaagagggtgagcccatggttggttgagcttgtgtcaaacatgccggccatccaccttgctccattctcgcctccacggaagaagctttgcgtgccgttgtaccccgagcttcccatcgacggccaatttccgacaccgatgttccatggaaacccgctcgcccgtggggttggtcctatgtgctatttcccggatggcactcctgcaggcatacagggagccaggcatgctcaatttggtatatctttatcagatctccaccttaacaaactgcagtcgagtctatcgccccacggctttcaccagcttgatcacggcatgcagccgaggatcgccgctggtctaattatcggtcatccggctgctcgggatgatatctcatgcttgttgaccattggtagcccccagaacaacaagaaatcagatggcaagaaggcgccagcccagctgatgcttttcggaaaacccatactcacagagcagcagatatccttgggtgatgctgcttcggtggatgttaagaagagctcttctgatggtaatgctgaaaatacggtgaataagagtaactccgatgtttcaagcccgagaagtaatcagaatggcaccacagataatttgtcatgtggaggagttccattgtgccaagacaacaaggtacttgatgttgggctggaaacagggcactgcaaggtattcatgcagtcggaggatgtcgggcgcacacttgatctctctgttgttggttcatatgaggaattataccgccggcttgctgacatgttcagcatcgagaaagctgagctgatgagtcatgttttctaccgtgatgcggctggggcactcaagcacactggagatgaacctttcagcgagttcacgaagacggcgcgtaggctgaatatactaacagatacaagcggcgataacttagcgaggtagggtaaattaaagctattctcaattgtacagctggtggagcacggtggcaattttgaaggcaaaaattgccggtttcctagtactggtgcaatttcaaggaggcaattcagttttctttaattagagctcccagaatgggattgactgtaatccggtaccatatttatcggcagatttaccagactggatctatcctactgtcatgtaaaccgatcatattgcatttgatcgttggtgtgtactcggccatgaaccgttactaaacgaatgcgattacgggaatttttgcgcgcaaatgcgttgaattgtctgaaaaaaaaaactacatctgcatgctctgtttgtagtacttcatcataccaaagaatcgaagaagtggagtcagaatggcccaaaatttgtgtgtgtcactgaatttggaattgaaattttgcagattgtacta

SEQ ID NO: 700 - DNA, 2125 bp, Oryza sativa
gaatttgggcacgggggagactaaattctcggagaaggaaggtgtccataattaagcgatcgattcgagtccccttcccttcctccctaaaccctaaccaaacccccaccactctctttccgcgcgccgcgtgcgacgatggcgcgcccgccagccgccaccgctccgcctcctcctccgccgccgccgccaccgccaccgccaccgatcgaccgcctcgtctggctcgcctgcgccgccccgctgtcccgcatccccgtcgtcggcacccaggtctcctacttcccagagggccacgccgagcagtgtcccgcccctctcccggatccgctcccctccgcccaccgattcttcctctgcaccatcaccgccgtcgacctctccgccgacaccaccaccggcgagccctacgccaccatctccctcctccctcttcgccacgacgcccccgcccccgcccccgcccccgcccccgccgccgccgaattagcagaagcagaatcacaggagttccgctactacgccaagcagctgacgcagagcgacgccaacaacggcggcggcttctccgtgccaaggttgtgcgccgatcacatcttcccggcgctcaacctggatgatgacccgcccgtccagagcctcaccatgggggacctgcagggcgactcgtgggaattccgccacatctaccgcggcacgccgcgccggcacctgctgacgaccgggtggagcaagttcgtgaacgccaagcagctggtggccggggacacggtggtgttcatgtggtgcggggccccggcccccgagaggaagctgttggtcggggtgcgacgcgcggccaggtactcgggcgagtcggcgtgcaacgcgcgggggcgggtgcagccccaggaggtgatggaggcggtccgactggcggcggagcaggcggcgttcagggtgacctactacccgcggcatggggcgggggagttcgtggtgccgcgggtggaggtggataagggattgactactccgtggaggtgcgggatgcaggtgcgcgcccaggtgatggaggccgaggacacccgccgcctcgcttggctcaatggcaccctcactaacctccgccaccaacaaatctggcgcactctcgaggttgaatgggatgcctccgccgcgtcatcttccatgaaaaacagatttgttaatccttggcaggtccagcctgttgatttccctcctcttcccatggggctaaagatttctaacaacaatattagtgcacctgtgtgcaatggggattcactgctggtgccaccgatactaatgcacccgcaacctcaacctcccgctgacattcagggagccaggcataacaatggccatgcctatgcagatataccctcttcatcaacaccatcaatggtgaggactcagcagctgttcccaagggatcttcagattttagttccccacaccgacattgtcactcctcaaaatggatcaccgcccgacaaccccgtaaacacgcctctttctgcatctgacggaatgaagaccatacagctgtttggcgtcacaataacatcacctgtgcaaggagacaccaatggcgctttcgcttcagcacaagtgaatcaggttccagagggtgtagatgatgaaactgctaccgaagaagcttctgacacaagcctacctgactctcttaccaatggccacaatcaagatggtgctaggctttgaaggaatatcccattaaacgtttccaagatatggctggaccagatttgtttctaacattttggtctgttctgtttcaccctccggcagtttgacgggatgtggtgttcttatgcatgcatttaatctggagtttaggctggcaactatgccgcatggtccagttaagtttggagtaatctggagaaacgttcatttctttgttagaattgttatagagcagcactgctctgttttattttccttgaattttcacacctgcactttgtttgcttgttgtttgtttacctgtattgatctgataaacatctttaatttcctggggaaccgttgaactctgctttgctgttgcggctagcttttccaattggtatggcataaggatttggcacttccaagc

SEQ ID NO: 701 - DNA, 2352 bp, Oryza sativa
atgatcacgttcgcggacctggcggagccggcgcccggcgccgagcggtgcgtcgaccggcagctgtggctggcgtgcgcggggggcatgtgcaccgtgccgccggtgggcgccgccgtgtactacttcccgcaggggcacgccgagcacgcgctcggcctcgccgcgccggagctctccgcggcgcgcgtcccggcgctcgtgccctgccgcgtcgcgtccgtgcggtacatggccgacccggacaccgacgaggtgttcgccaggatccgcctcgtgccgctccgcgccgcggaggatggggacgtcgaggaggatggcgccgcggcaggcgaggagcacgagaagccggcgtcgttcgccaagacgctgacgcagtcggatgccaacaacggcggggggttctcggtgcccaggtactgcgccgagaccatcttcccgcgcctggactacgccgccgacccgcccgtgcagaccgtcgtcgccaaggacgtccatggagtcgcctggaacttccgccacatctacaggggcacgccgcgccggcacctgctcaccacggggtggagcacgttcgtgaaccagaagaagctcgtggccggcgactccatcgtgttcctccgcggcgacggaggggacctgcacgtcggcatccggcgcgccaagcgcgggttttgcggcggcggaggcggagccgaggaggcctccctgcccgggtgggaccagtacggcggcctgatgcgaggcaatgcgagcccgtgcgcggccgccaaggggcggggcaaggtgcgcgcggaggacctcgtcgaggcggcgaggctggcgaacggcgggcagccgttcgaggtcgtgtactacccgcgcgccagcacgccggagttctgcgtgcgcgcggcggcggtccgcgcggcgatgcgggtgcagtggtgccccgggatgcggttcaagatggcgttcgagaccgaggactcctcccggatcagctggttcatgggcaccgtcgccagcgtccaggtcgccgaccccatccgttggccgcagtcgccgtggcggcttctccaggtgacctgggacgaaccggacctcctccagaacgtgaagcgggtgagcccatggttggtcgagctggtgtcgagcatgccggccatcaacctctcgtctttctcgccgccgcgcaagaagccccggattctggcgtacccggagttccccttcgaggggcagctcctcaacccggcgttcccgccaaacccgctggcacacggccaccaccattaccatcacaaccacccgtccttcttcccgttccccgacgttagtgctcctgcaggcatacagggagccaggcatgcgcaatttggtccatctttatcagatctccaccttacccacctgcagtcgagcctcatgtacccggggctccgccgccccgatcatgtcggtccaacatccatcccgccaccaagaatcagcactgacctgacaatgggcagctcgccgccggcgcgcgctctgtccatgggcgccaagaagcccgacgacgccaagccgccggggctaatgctgttcgggcagaggatactgaccgagcgccagatgagccttagcggcaccacctcgccggcggccaccgggaacagctctctcaactggaacaccgagaaaggtgcctcggagggctcgggctccggcgtcatccagaacagccccaccgacaacacgtcgtcggagaggctccagtggttcagggagaacagcaccgtctccgagctcgggctggagcccgggcagtgcaaggtgttcatcgagtccgacacggtcggccgcaacctcgacctctcgtcgctggcctcgttcgagcagctctacggccggctgtccgagatgttctgcatcgacagcgcggagctgaggagccgtgtgctctaccgtggcgccaccggcgaagtgaggcacgccggcgacgagccattcagtagagatttcaacaagaaagctcaatctgcacaggtatcctactgttctcctgtatccttcttcatcatcatcaacaacgatcagctgcgtgtacttgttgattcccgtgtactacgatgcaaaaatcctgtgaccactcatcagaggcttgaatgccgcggccccttggcccaagggacaagcgcatgcagcatgcagacgcagacgcagcgctgcgccatttctgacctctccggtggcctgacctccaggctccagcctccaggcgaggcaatccctcttggttctcttgccttggcagcaagctcgcttacccatgatgatgagatttgtgatctgcatcgtgctgcgtatccctggctagtagagagctag

SEQ ID NO: 702 - DNA, 1315 bp, Oryza sativa
gccaggtggttcagtggaatattcttgcaagcttcagctcccttgtaatgccccgttcgaaaaacttgagggtcctatatgcagttcaatacgactggcacagcaggctgtttgtttggctgcttgtaagaagctgcatgagatgggtgccttcacagatacgctcttacctgacagaggaagcggggaaggggaaaaaactgagcagaatgatggaattgaaccaccgacccacgcgtccggccatagagagttttatcctgaaggtgttgctgatattctacggggagaatggattttatctggcagagatggctaccaaaactctcaatttattaagttatatatgtattctgtgaactgtgtaaacgttgggacttctaaggaccctttcgttacacaactttcaaattttgcaattatttttggcaatgagccggatgcagaggttttatcgacgacgatggatctctttgttgcaaggacaatgataacaaaggcatctctcgtattccgtggacgaattgaaattacagaaagtcagctggtgttgctgaagagctttcatgttaggctcatgagcatagtacttgatgttgatgttgatccctcaactacaccttgggatcccgcaaaagcatacctctttgtccctgtaggagctgagaagtgtacagatcctttaagagagattgattggactttggttaactacattgttaacactgatgcctggaacaatccacttcagagggcacgcccagatgtctatctaggcaccaatgaacgaacacttggtggggataggagggaatacgggtttgggaaattgcgccatgggactgcttttggacaaaaggcccatcctacttatggtattaggggagctattgctgaatttgacattgtgaaagcatctggattagttcctgctcgtgatagaggacattttagtgattatcagaaccaaggcaagttgttcatggcagattcatgttggaatgctaaagatcttgctggaatggttgtcactgctgcccactcagggaagaggttttatgtggactgcatttgctataacatgaatgcagaaaattcattccctaggaaagaaggctacctggggccattggagtatagttcatatgctgattactacaagcagaagtacggtgtggagttaatctataggaaacagcctcttatacgggcccgtggtgtttcatattgcaagaatcttctttctcctagatttgagcattctgacgctagagaaggtgacttctctgagaaccttgacaaaccatactacgtg

SEQ ID NO: 703 - DNA, 1468 bp, Oryza sativa
atacaacgatttcctcttgtcaccctgaatctacttctgctgcaaaagcaataagcaaggagcagttagccaggtaaagctctagctagctagcttaggcagcaatggagcagcatcagggccaggcaggcatggacttgccccctggcttccgcttccacccgaccgacgaggagctgatcacgcactacctcgccaagaaggtcgccgacgcccgcttcgccgccctcgccgtcgccgaggccgacctcaacaagtgcgagccctgggacctgccatctctggcgaagatgggggagaaggagtggtacttcttctgcctcaaggacaggaagtacccgacggggctgaggacgaacagggcgacggagtccgggtactggaaggccacggggaaggacaaggacatcttcagacggaaggccctcgtcggcatgaagaagacgctcgttttctacacggggcgcgctcccaagggggagaagtctggctgggtcatgcacgagtaccgcctccacggcaagctccacgccgccgccctcggcttcctccacggcaagcccgcgtcgtccaagaacgagtgggtgttgtgcagggtgttcaagaagagcctcgtggaggtgggcgcggcgggagggaagaaggcggccgtggtgacgatggagatggcgaggggagggtcgacgtcgtcgtccgtggcggacgagatcgccatgtcgtccgtcgtcctccctccgctgatggacatgtccggagccggcgccggcgccgtcgacccggcgacgacggcgcacgtgacctgcttctccaacgcgctggagggccagttctttaacccgacggcagtacacgggcacggcggcggcgactcctcgccgttcatggcgagcttcacgcagtacgggcagctgcaccacggcgtgagcctggtgcaactcctggagagctgcaacggctacggcggcctcgtcgacatggcagcgtccggcagccagctgcagccggcggcgtgcggcggcgagcgggagaggcttagcgcgtcgcaggacaccggcctcacctccgacgtgaacccggagatctcgtcatcctccggccaaaaattcgaccacgaggccgcgctatggggctactaaggtttgatatgatcagcgccgtgtacgttaatcgcgggcgattagcgaagtagcgattactgtaaataaaaccatgagatcgcgatcgaggcatctaccaaggttcgcttaatttgcttgtacctataggtgtagattatttggtgatttgggagatgtaattagcattgtttgtttgtaattcgtatcagaatgatcgatgcagtattgtttggagggttagttaagcaattggccactcctcagttgccagttaattagttagttagctctttctaaaaagctagcagagactaatagctaacttctctaaaagtttgacctgctgtgtg

SEQ ID NO: 704 - DNA, 1491 bp, Oryza sativa
ctggcacgcgaaccaagaaaagtctctctctcctctcctctcttcttcatcaacacacactggttgaccaaccagctagctgatcgagttcgttgtttaccatcctattaataccccttcctctctctcttctcccctcctgaatttctctcttggtagaggtagaattgatctcctttcttgttcttcttcgagttcttcttaattggagttcttggagcagcatcggtagtcgtcgtcttcgtcgatccagcatctcaaggaattcgaggaggagggggtgggcatgagcgggatgaattcgctgagcatggtggaggcgaggctgccgccggggttcaggttccacccgcgagacgacgagctcgtgctggactacctggaaaggaagctcctcgacggcggcgtgggcggcgccgcggcggcggcggcggcggtcaccatctacggctgcccggtgatggtcgacgtcgatctcaacaagtgcgagccatgggaccttcctgagatcgcttgcgttggtggcaaggagtggtacttctatagccttagggataggaagtatgcaactggccaacgaacaaatagagcaaccgaatcgggctactggaaggccacaggaaaagatcgcccaataagccggaaaggattgctcgtcggtatgcgaaaaaccctggtgttctacaaaggtagagcccctaaggggaagaagaccgagtgggtcatgcatgaattccgcaaagaaggacaaggggatccgatgaagttgcctctcaaggaggactgggtcttgtgtagagtcttctacaagagtaggacaaccattgccaagctgccaacggagggtagctacaacaatattgacagtgtggccacaacttcactgcctcccctcactgacaactacattgcatttgatcagcctggttcaatgcaaaacctagagggttatgagcaagtgccctgcttctccaataatccctctcaacagccatcgtcgtcgatgaatgttccgttgacatcggccatggttgatcaagagcaaaacaatatgggtagggcgatcaaggatgtgctgagccaattcaccaagtttgaaggcaatgtgaagagggaggcccttcaaagtaatttttcccaggatggatttgattacttggctgagagtggcttcacacaaatgtggaactcactcagttgatttaatttcgaaggagatatatattgattgttgcgaattgaggaggaaactcttaaagtgtgcttatgtgctattgcatgtaattgtgatatagacgtatagtaccattctagttcacattatttgcaaaaaaaaaggggtgatcaaaagagatattatcatcatcaatgatgtaaatacattatttgtgtactagggtgtgataaaaaaaattagtgcatgatgctaaaattaatggtatatatcaatagagctagaatcttcttttaaaaaaaaaaaaaaaaaaaaag

SEQ ID NO: 705 - DNA, 686 bp, Oryza sativa
gccgagctcgccattagcttgctattctctcttcttcttcttcttcttcttcttcttcttcttcttcttcttggtgtgattgaggtggaggaggagatgagtttcataggcatggtggaggcgagaatgccgccggggttcaggttccacccgagggacgacgagctggtgctggactacctcctgcacaagctcgccgccggcggccggggaggaggggtgtacggccacactgcattcattactaatccctatctaccaagtaacaacacaaacatcatcaatatcaatatcaatatcaatatcaatatcaatatcaagatcaagatcattattgggggttccacatctgtgacaggccactctcctgtccccaatctggggagagctccagctttgcagtgttgctgttgtgcagtaccctgatggccttcttctctgcagaggtgtccatggccagcaggtccccaaagctgatggagcccttcattggcaatgccggcaggccggaaaagcaggacacttgctcgtagctcccgaccatcgatggcgtcgtcgtcggtgcgctatccaaggcgatgtaggcatccatgaggggcgggagccaaggcgtggcaggcaagtctagctcattgggcagtgtgacggcctcttcaaatgatgggcttggaattgtttgtctggtc

SEQ ID NO: 706 - DNA, 1395 bp, Oryza sativa
tgtgttaatattctgggtcctttgcttaatggttggtgttggctccttctgatgaatttcccccttaaccacttcatcacttctctcgtcgatctagtctaaaaggtttagtagatgcgattagccaggcagcagcagcaggtggtggtggctgcgacgatggagcatgacgtgcaccaccaccggcagatgatgcagcagcagcagcagcaggagatggacctgccgccgggcttccggttccaccccaccgacgaggagctcatcacgcactacctcctccgcaaggccgccgaccccgccgggttcgccgcgcgcgccgtcggagaggccgacctcaacaagtgcgagccatgggacctgccatcgagggcgacgatgggggagaaggagtggtacttcttctgcgtgaaggaccggaagtacccgacggggctgaggacgaacagggcgacggagtccgggtactggaaggcgacggggaaggaccgggagatcttcagggggaaggccctcgtcggcatgaagaagacgctcgtcttctacaccgggagggccccccgcggcggcaagaccggatgggtcatgcacgagtaccgcatccacggcaagcacgccgccgccaattccaagcaggatcaggagtgggtgctgtgcagggtgttcaagaagagcctcgagctggcgccggcggcggcggcggcggtcggcaggagaggcgcgggcgcggggacggacgttgggccgtcgtcgatgcccatggcggacgacgtcgtcggcctcgccccgtgcgcgctcccgccgctgatggacgtgtctggcggcggcggtggcgccggcacaacctcgctgtcagcgaccgcgggcgcggcggcggcgccgccgccagcgcacgtgacctgcttctccaacgcgctggagggccagttcctggacacaccgtacctcctccccgccgccgatcccgcggatcacctcgccatgtcctccgcctcgccgttcttggaggccctgcagatgcagtacgtccaggacgccgccgccgccggaggagcgggcatggtgcacgagctgctcatgggcggcggctggtattgcaacaagggcgagagggagaggctgagcggcgcctcgcaggacaccggcctcacgtcgtcggaggtgaaccccggcgagatctcgtcgtcgtcgcggcagcaacgcatggatcatcacgacgcgtccctctgggcctattgaaatattcattcatcatcattgaaaattgcattagccattattattagtactgttggcacgattattgattgtgttgtaatattggtatgttgatataattaattagtacgccaaagagacaaatcacaagagaaaaaaaaaaaaaaaaaaaaaaaa

SEQ ID NO: 707 - DNA, 1538 bp, Oryza sativa
gacaatttgcaacacacacacacacatgacacaagcacacacacccctattcatacacatactccatatgtagccctttcttggtttctctctctagcagctactacccttcaatttccttaattctctctcttcttgttcttcttcttcctccatatagctagctagagagagagagagagagagagagaggaggtgatcaagggggggaggttgatcgatgtcgatgatgagcttcttgagcatggtggaggcggagctgccgccggggttcaggttccacccgagggacgacgagctcatctgcgactacctggcgcccaaggtcgccggcaaggtcggcttctccggccgccgcccgcccatggtcgacgtcgacctcaacaaggtcgagccatgggacctccccgaggtggcgtcggtgggcggaaaggagtggtacttcttcagcctgagggaccgaaaatacgcgacggggcagcgtacgaaccgagccacggtttcggggtactggaaggccacggggaaggacagggtggtggcacgaagaggggcacttgtggggatgaggaagacactggtgttctaccaggggagggcacccaagggaaggaagacagagtgggtgatgcatgagtacaggatggagggtgtgcatgatcaacaagcttccagcttctcctccaaggaagactgggtcctgtgcagagtcatctgcaagaggaaatcaggagggggtgcaacctccaagtcaagaagcctcaccaccaccaccaccaccattgtccatgacacatccacaccaacctcctcaccaccattgccacccctcatggacaccaccctagctcagctccaggcctccatgaacacctcctcctcctccgccatcgccgccgtcgccgcacttgagcaagtgccctgcttctccagcttcagcaacagcattgccagtaacaacaacaacagcaacagtgctactgtcaatgcacagcaatgctacctgccaattgtcacaggtagcaacaacaatggcatgagctacctggatcatggcctgcctgaatttggcagcttcttggacacccagagctgtgacaagaagatgctcaaggcagtgctgagccagctcaactccattgggggtgaggtgttgccaggcctgcctcctccatctgaaatggctgctgctgtcagctcttcttggatgaatcacttctagggaaaaatattattcagacaatataagaatagctagctagctagtagttgatcttcagtgtgtatgatgaattgatgatttgatatggtatacatacttatttgtgtgatggtacaatatttatgtgtgagtattaatagagcatgccatagtttttctgtaaggcataggaaaattcaggactaaaactatgtaatgattgctaaagtgtgtatactcagaaatcagaagtagaggtttgcgttgtcgaaaaattttcggaacaatgattttctgtcgtcctgcttgtgcatatctatatggagtagtatacaaa

SEQ ID NO: 708 - DNA, 1673 bp, Oryza sativa
gatttttccgatatacaacgatttcctcttgtcaccctgaatctacttctgctgcaaaagcaataagcaaggagcagttagccaggtaaagctctagctagctagcttaggcagcaatggagcagcatcagggccaggcaggcatggacttgccccctggcttccgcttccacccgaccgacgaggagctgatcacgcactacctcgccaagaaggtcgccgacgcccgcttcgccgccctcgccgtcgccgaggccgacctcaacaagtgcgagccctgggacctgccatctctggcgaagatgggggagaaggagtggtacttcttctgcctcaaggacaggaagtacccgacggggctgaggacgaacagggcgacggagtccgggtactggaaggccacggggaaggacaaggacatcttcagacggaaggccctcgtcggcatgaagaagacgctcgttttctacacggggcgcgctcccaagggggagaagtctggctgggtcatgcacgagtaccgcctccacggcaagctccacgccgccgccctcggcttcctccacggcaagcccgcgtcgtccaaggtacacgaacgcacgtacgccgcgtgcgtgtgtttggttgtgaccagtttgatcgatcgatcgatcgatcgattgagcaggccggactgacacgccgtgggtttttcttgttggtgcgtagaacgagtgggtgttgtgcagggtgttcaagaagagcctcgtggaggtgggcgcggcgggagggaagaaggcggccgtggtgacgatggagatggcgaggggagggtcgacgtcgtcgtccgtggcggacgagatcgccatgtcgtccgtcgtcctccctccgctgatggacatgtccggagccggcgccggcgccgtcgacccggcgacgacggcgcacgtgacctgcttctccaacgcgctggagggccagttctttaacccgacggcagtacacgggcacggcggcggcgactcctcgccgttcatggcgagcttcacgcagtacgggcagctgcaccacggcgtgagcctggtgcaactcctggagagctgcaacggctacggcggcctcgtcgacatggcagcgtccggcagccagctgcagccggcggcgtgcggcggcgagcgggagaggcttagcgcgtcgcaggacaccggcctcacctccgacgtgaacccggagatctcgtcatcctccggccaaaaattcgaccacgaggccgcgctatggggctactaaggtttgatatgatcagcgccgtgtacgttaatcgcgggcgattagcgaagtagcgattactgtaaataaaaccatgagatcgcgatcgaggcatctaccaaggttcgcttaatttgcttgtacctataggtgtagattatttggtgatttgggagatgtaattagcattgtttgtttgtaattcgtatcagaatgatcgatgcagtattgtttggagggttagttaagcaattggccactcctcagttgccagttaattagttagagttgcttaatttagctctttctaaaaagctagcagagactaatagctaactgtgatctcatcctgaacctaaaagtttgacctgctgtgtgatatagtagctggtaccatcagctatagctaatctagcatttaaagc

SEQ ID NO: 709 - DNA, 3138 bp, Oryza sativa
aggcttcccctgtccaccactattaaaccaacccccaccccttctctctcctgctctaccgtccttcccttcttctctctcgctacctttcccttcccacctcctcctcctcctcctcaccaccaccacgcgcctccgctcgcaagaagcacctccgaccgccatggcgcgcgcgggagctggcggcagtctctccctggaggcatgacgcggcggcgcccgtggccgtggctcctgttgctactactgcgaccaactactgcgctcggtcggcggtggtggtggccctggtcgtcgtcgtagcgcgtcggcggaggcgggagaagaaggagaagggtcgacggggatggcggcggcgatggtggcggcggtgcatggagtggggaggcaggacaggtcgtcgcctggcggcggaggggcgccgcaagtggacacgggcaagtacgtgcgctacaccccggagcaggtggaggcgctggagcgggtctacggcgagtgccccaagcccagctcgctccgccgccagcagctcatccgcgagtgccccatactcagcaacatcgagcccaagcagatcaaggtctggttccagaaccgcaggtgccgcgagaagcagcgcaaggaggcatctcgcctgcaaactgtgaaccggaagctgaatgcgatgaacaagctgttgatggaggagaatgacaggctgcagaagcaggtgtcccgcctcgtttacgagaacggctacatgcggactcaactgcacaatccttctgcagccaccacagatacaagctgtgagtctgtggtgacaagtggtcaacaccaccaacagcaaaacccagcagccacgcgtccgcaaagggacgcgaacaacccagctggtcttctcgctattgctgaggagaccttggcagagttcatgtcgaaggcgacaggaactgctgtcgaatgggtgcaaatggttgggatgaagcctggtccggattccattggaatcatcgctgtttcgcacaattgcagtggcgtagcagcacgagcttgcggccttgtgagccttgagcccacaaaggttgcggagatccttaaggatcgcccatcttggtatcgcgattgccggtgtgtcgatatcatccatgttatccctacgggtaacggcggaaccattgagctaatctacatgcagacttatgcaccgacaactttggcggcaccacgcgacttctggactctccgttacactagtggtcttgaggatggaagtcttgtgatctgtgaaaggtcattgactcagtccactggtggcccatctgggcctaacactccgaattttatcagagccgaggtacttcccagtggttatctgattcgaccatgtgagggaggtggctccatgatttacattgttgatcatgttgatttggatgcttggagtgtgcctgaggttcttcgaccgctctatgaatctccaaagatccttgcacagaagatgaccattgcagcattgcgacacattaggcaaattgcacatgagtcaagcggtgaaatcccctacggtgctggtcgccagcctgctgttttgaggaccttcagtcaaaggctcagcagaggtttcaatgatgctgttagtggattcccagatgatggctggtctttgttgagcagtgatggtgctgaggatgttacaattgcttttaactcgtctccaaacaagcttgttggatcccatgtcagctcctaccctctgttttctactgttggaggtggcatcttgtgtgcaaaggcatcaatgctacttcagaatgtacctcctgctctcctagtgcgatttttgagggagcaccgctctgaatgggctgatcctggtgttgatgcttattctgctgctgcgttgagggctagtccatatgcagttcctggtctgcgagctggtggttttatgggcagtcaggttatattgccacttgcgcacaccttagagcatgaagagttcctggaggtcattaggcttgagggacacagcctctgccatgatgaggtcgttctatcaagagatatgtaccttctgcagctgtgcagcggtgtagatgaaaatgctgcgggtgcatgtgcccagcttgtctttgcacccattgacgaatcttttgctgatgatgcaccactgctaccctcaggcttccgtgtgataccactggatggcaagacggatgcaccatctgcgacacgcacacttgacctggcatctactcttgaggttggatcgggtgggactacacgggcttctagtgacacctcgagcacctgcaacacaagatcggtcctgaccatagctttccaattctcatatgaaaaccaccttcgtgaaagcgtagcggcaatggccaggcagtatgtccggaccgtggtggcatcagtgcagagagtggccatggcaatagctccttcacgtcttggtggacagattgaaacaaagaaccctccaggatctcctgaggcccatacgcttgcaaggtggattgggaggagctaccgattccacactggagcggatctccttcgcacagactcacaaagcacggattcttccttgaaagcaatgtggcaacactctgattcaatcatgtgctgctccctgaaggctgctcctgtgttcaccttcgccaaccaagccggcctcgacatgctggagacgacgctgattgctctccaggacatctcgctcgagaagatcctcgatgatgatggccggaaggcactatgtacagagttccccaagatcatgcagcagggtttcgcctacctcccgggcggcgtgtgcgtgtcgagcatggggcggccggtgtcgtacgagcaggcggtggcgtggaaggtcctgagcgacgacgacacgccgcactgcctcgccttcatgttcgtcaactggtcattcgtctgagaaccaccctagtagaatcgatcccccctcttgtttgtctgtcctaaagaccttatgtagtattgcttttgtgtatcatcaccatgaacatgtcaagaacctccccagtttctatcatcatgaacttccgtttgaatctagtactgctaaatgatctatatggtatctttatctgtgagagattttgccccggaaagtttgtcacggaagga

SEQ ID NO: 710 - DNA, 2751 bp, Oryza sativa
atgaggctttcgtcgtcgtccggcagcgtcctcccggctcaggcggcgtcgccggaagctgtagaagaacaaaaatgcctgaattcggagctctggcatgcgtgtgccggtccccttgtttcgttgcctgcagtgggtagccgagtggtttatttcccacagggtcacagcgaacaggtagctgcatcaacaaataaagaaatggagtctcagatccccaattatcctaacttgcctccacaacttatttgccaacttcacaatgtgacgatgcatgcagatgcagaaacagatgaggtttacgctcagatgacgctacaaccacttagcccgcaagagctcaaggacccatatctaccagctgaattaggttctgccaacaaacagccaacgaattatttttgcaaaacattaacggcaagtgacacaagtacgcatggcggattctctgttccccgtcgagcagctgagaaagtgttccctccgctggattttactcagcagcctccagcacaggagttaattgcaaaagatcttcatggcaatgagtggaagtttcgtcatatctttcgtggtcagccaaagcgacaccttctaactacaggctggagcgtctttgtaagtgcaaagagacttgtcgccggggattctgtcctatttatctggaatgacaacaaccagcttcttctgggaattcgtcgagctaaccgcccacaaactgttatgccatcttcagtcctatctagtgatagcatgcatattggtcttcttgctgcggctgctcatgctgcttcaacaaatagccggtttacaattttttataacccaagagcaagcccttcagagtttgttatcccactttctaaatatgttaaggctgtatatcatacccgtatatctgtgggcatgcgtttcaggatgctttttgagacagaagagtcaagtgtacggagatacatgggcacgataacaggaattagtgatcttgatgctgctcgttggccaaactcacattggcgttctgtaaaggttggctgggatgaatcaactgccggagagaggcagccaagggtgtcgctttgggagattgagcccttgacaactttcccaatgtacccatctccttttccactcagactgaagcgtccatggccaacaggcttgccttcattacatggtggtaaggatgacgacttgacttcttctctcatgtggctccgagacagcgcaaatcctggtttccaatcattgaatttcgggggtctcggtatgaatccttggatgcagccaaggtttgatgcttccttacttggtctgcaacctgacatgtatcaaacgatagctgcgactgctttccaggacccaacaaagcaggtctctcccacgatattgcagttccagcagccgcagaacataggtggcagagctaatacacttctgccaagtcagattttgcagcaagtgcagcctcagtttcagcagcagcaatacctccaaaacatcaacgagaccacaatccaagggcatgctcagtctgagttccttcagcagcagctccaacgctgccagtcgtttactgagcagaagccacagctgcaaacccagcaacaacagcaagaatcacagcaacaacagcagcagcaatcgcagtgtatgcaagtcccacaacatcagcaaatgcaacagcagaagaacatgaccaactatcagtctgtacctaatgcattgtcaccgttttctcaactctcctctccttctcagtcttcacctatgacactgcaaacagtattaccattctcccagccacagagctatccagacacgagtatgagctcattgtcaccatccaacacatccaccatgcataatgcattgaggccattttcatcggaagcaccttcgcacctaagcatgccaagaccgactgcagtacctgtccctgacccatggtcatcgaagcgagttgcagtggagtctttgcttccctctcgtcctcaggttacatcgcagatggagcagttggactcaacagcacctagtataccacaaagctctgcgttggcgccgcttcctggaagaggatgcttggtggatcaagatgggaactctgatcctcaaaaccatctgttatttggcgttaacatagattcacagtcacttctaatgcaaggtggcatcccaagcctccagggtgagaatgattcgacggcaattccttattccacctccaatttcctgagcccgtcgcagaatgatttccccttggatcaaacactaagtagtgcagactgcttagatgaatcaggatatgtgccgtgttcacagaattctgatcaagtgattaatcgaccacctgcgacctttgtgaaggtttacaaatcgggaacctatggaaggtcacttgatatcactagatttagtagctatcatgaacttcgtagagaactagggcgcctatttggccttgagggccagttggaaaaccctttgagatcaggctggcagcttgtattcgtcgaccgagaggatgatgtcctcctcgttggcgacgacccttggcaggaattcgtgaatagcgtctcctgcataaagatactttcaccacaggaggtgcagcagatgggcaagccctttgagcttttgagctcggctcccggaaagaggctaggtagcagctgtgatgactatgtgagcaggcaggaatcaagaagcctgagcacaggaattgcatctgtcggctcagttgaattc

SEQ ID NO: 711 - DNA, 3363 bp, Oryza sativa
gcttcagacactgtgcgggagctcacgctactgtacggccccctgcgctgcgccccccctcgtcgcgcacacgcacaaacgcactcgaactactcgaaccacgcgaacccctctctttctctctctctctctctctcgcttaaatgccacaaacctaatcatttccacccctcttgcgctctctctctctctctccaaccccaccctttctccccaccatggtggcgatctccgagctcgggtgagcggaagagaaagaatgcggccgatttgaggagggggatggggttttcgggtggatttgtgaggggatagattaagagtttgtgcttctctggtttggtcggaggaggaggagatgagctcgtcgtcggcggccagcatcgggccgccgcagccgccgccgccccccgcgccgcccgaggaaggtgggtggctagagaagaagtgcctcaactcggagctatggcacgcctgcgccggcccgctcgtctgcctccccaccgtcggcacgcgcgtcgtctacttcccgcaaggccacagcgagcaggtggcggcgtcgacgaacaaggaggtggagggtcacatcccgaactaccccaacctgccggcgcagctgatctgccagctccacgatgtcacaatgcatgcggatgtggagactgacgaggtgtacgcgcagatgacgctccagccactgaacccacaggagcagaacgatgcgtaccttcccgcggagatggggataatgagcaagcagccgacgaattacttctgcaagacattgacggcgagcgacaccagcacgcacggggggttctccgtgccccgccgtgctgctgagcgcgtcttccctcctttggatttcacacagcagcctccagcccaggagctaattgcacgggatattcatgacatcgagtggaagttcaggcacatctttcgaggccaacccaaacgacacctgctaaccactggctggagcgtttttgtcagtgctaagagacttgttgctggagattctgtgcttttcatatggaacgagaaaaaccagcttttacttggaataagacgtgccagtcggccacagactgtgatgccttcctctgttctttcaagcgatagcatgcacataggtctccttgcagcagcagctcatgctgctgctacaaacagccgtttcactattttctacaacccccgggcaagtccatcagaatttgtcataccactgtcaaaatacatcaaggctgtttttcacacccggatatcggttgggatgcggttcaggatgttgtttgagactgaggaatcaagcgttcgcaggtatatggggactataactgaagttagtgatgcagacccagtccgttggcctagttcctattggagatctgtgaaggttggttgggatgaatcaactgcaggggaaagaccaccaagagtttctttatgggaaattgaaccattgacaacctttccaatgtatccatctctgttcccactgagagttaagcatccttggtattcaggagttgcttccctgcatgatgacagcaatgctttaatgtggctgagaggagttgctggtgagggaggttttcagtctctgaactttcagtcacctggtattggctcctggggacaacagaggctccatccatccttactgagcagcgatcacgatcagtaccaagcagtagttgctgctgctgctgcttcccaatctggtggttacttaaaacagcaattcttgcaccttcagcaacctatgcagtcccctcaagaacactgcaacctcaacccattattgcagcaacaaattctgcagcaagcaagccagcaacagataattaatcctgatgcccaaaatatccaaacgatgttgagcccaagtgctatacaacagcaactccagcaactacagcaaatgcagcaagttcagaatgatcagaagcagaagattcaaccagatcaaagctaccaagttcctacaagtgcagttctcccaagtccaacatcattaccgagtcatttgcgagaaaaatttggcttctctgatcctaatgcgaattcttcaagcttcatcacctctagcagtagtgataacatgttggattcgagcttccttcagggaagttcgaaagctgtggacttatctcgatttaatcagcctgtagctagtgagcagcagcagcagcagcaacaggcatggaagcagaagtttatgggttcacagtcagtgtcttttgggggctcggttttgcataactcacccacaagcaaagatggttctgttgaaaacaaaattggtcgtgatgtgcaaaaccagtccctttttagtccacaagttgactcttcatccctcctgtacaacatggttcctaatctgacttcgaatgtttcggatggcaacttatcaacgatcccttctggatcaacttatctgcagaatgcaatgtatggttgcttggacgactcttctggtttattgcaaaatacaggagagaacgatccagcaaccagaacatttgtgaaggtttacaagtcaggttcggttgggaggtcgttggacataacccggttctctaattatgctgaacttcgagaagaactgggtcagatgttcggcattaagggtcaattggacgaccctgatagatcaggctggcagcttgtattcgtcgacagggagaatgatgtgcttctccttggagacgacccttgggagtcctttgtgaatagtgtatggtacatcaagatactttcacctgaggatgtgcataagatgggaaagcaaggaaatgatccacggtatctgtcctgaagtgagagaacatggtgccatttctgggcttccaggaggattctgcagtgcatggtggcactcttgctctcgacaatgcacgtcgtcagaagtcccaaatttgtatcttgcatgtacgccgtacatgtttccagaactctctgttacctattcggtgcaggccaccggaaccacgaaacctgatattttgtaggttccacttaggaatcagtatcggtttaactcttatcctagatgatttgtaactcgcacggcagtccactgttttcatgtttcatcgagtcttcctagacattaaacttagttgatattgtatcaggatttatgtgtattgagattcctctacatgctttcaaccaaaaaaaactgcaataatcgaagcgcacgaggattgtttcaattcgtgttgtaggatctggattttcaccgattgtccggttatgtcagtttcgagaggagctgtcaatctgaagttttttctgtagtgcctaatattttgcttttattattaatgctaatcatatactgttgtgatg

SEQ ID NO: 712 - DNA, 3279 bp, Oryza sativa
atgatgagaaagaaaaaaactgaaccccgtaatgctggggaaagttctggaactcaacaagccactggagctcctggacggggtccttcacagcgacctgagagagctcaacagcatggaggtggtggttggcaacctgccaatcctcaatatgctcaacaagctggtcgtggtggtggacaacaccagggacgtggtggacgttaccagggtcgtggagggccaacatcacatcaaccaggtggtggtccggttgaatatcaagcacatgagtactatggccgtggtgtccaacggcaaggaggaatgccacaacacaggagtggcagtggtggacatggagttcctgccagtccatcaagaacagttcccgagctgcaccaagcctcacaagaccagtaccaagctacggtggttgcaccatcaccatcaagaactggcccatcttcgctgcctgttgaggccagcagcgaagaagtccaacatcagtttcaggaacttgccatccagggtcaaagccccactagccaggccattcaaccagcaccaccatcgagcaaatcagtgagatttccaatgcgccctggcaagggtacatttggtgataggtgcatcgtgaaagccaaccatttctttgctgaattgcctgacaaagaccttcaccagtatgatgtgtctataactcctgaggttccttcacgtggtgtcaatcgtgctgtcattggagaaattgtaacacaatataggcagtctcatttgggtggccgtcttccagtctatgatggaaggaagagcttatacacagctggtccattaccatttacttctaggacctttgacgttattctgcaggatgaggaagagagccttgctgttgggcaaggtgcacagaggcgtgagagaccatttaaggtcgtgatcaaatttgctgcacgcgctgatctccaccatttagccatgtttttagctggaaggcaagcggatgctcctcaagaagctcttcaagttcttgacattgttctacgtgaattgcctactgcaaggtactctccagttgcaaggtcattttattcgcctaacttaggaaggcgccaacaacttggcgagggcctggaaagttggcgtggtttttaccaaagcatacgacccacgcagatgggactttctctgaatattgatatgtcatcgacagcattcattgagcctctacctgtgattgactttgttgcacagcttttgaacagagacatctcagttagaccattatctgatgctgatcgtgtgaagatcaagaaggccctaaggggtgtaaaggttgaggtcacacatagaggcaatatgcgcaggaagtatcgcatttctggccttacctcgcaagcaacacgagagttgtcttttcccattgataatcatggtactgtgaagacggtggtgcaatacttccaggagacatatggatttaacattaagcacacaactttgccttgcttgcaagtgggcaatcaacaaaggccaaattatctaccaatggaggtctgtaagattgtggagggacagcgttactcaaaaagactaaatgagaagcagataactgctcttcttaaagtgacctgccagcgccctcaagagcgtgagctggacattttgcagactgtgcatcacaatgcataccatcaggatccatatgcacaggagtttggcataaggatcgatgagcgacttgcatctgttgaagctcgtgttctaccacccccctggcttaagtaccacgatagtggcagagagaaggatgtcttgccaagaattggccaatggaatatgatgaataagaaaatggtcaatggtggtagagttaacaactggacatgcatcaatttttctcgtcatgtccaagataatgctgctaggagtttctgtcgcgagcttgctattatgtgccaaatatctgggatggacttctcaattgatcctgtggttcctctagtgactgcaagacctgaacatgtggaaagagcgctcaaggcacgctatcaagaggccatgaatatactgaaaccacagggcggggagcttgacctgctgattgcaatattgcctgacaataatggttctctttatggcgatctcaaaaggatatgtgagactgatcttggattggtctcgcaatgctgtcttacgaagcatgtttttaagatgagcaaacagtatttagcaaacgttgcccttaaaatcaatgttaaggtgggaggaagaaatacagtacttgttgatgctttgacaaggaggattccccttgtgagtgataggccaacgatcatttttggtgctgatgttacacatccccatcctggagaagattctagcccttccattgcagctgttgttgcttctcaagactggcctgaggtcaccaaatatgccggattagtgagtgcacaggcccatcgtcaggaattgatacaggatctttttaaagtatggaaagatcctcaaagaggaactgtaagtggtggaatgatcagagagcttctcatttctttcaagagggcaactggacagaaaccccagaggattatattttacagggatggtgtcagtgaaggacagttttatcaggttctgttttatgagcttgatgccattagaaagaagcgtcatcacacaaggctgtttgctaataaccacaaggaccagcgcactgttgacagaagtggaaatatactaccaggcaccgtggttgattcaaagatatgccatcctactgagtttgatttctacctgtgtagccatgcgggcattcagggaacaagtcgccctgcacattatcatgttctgtgggatgagaacaagttcactgctgatggtttgcaaactctgacaaacaacttgtgctacacctatgcaaggtgcacccgttccgtatcaatcgttcctcctgcatattatgcccatctcgcggcatttcgagctcgattttacatggagccggatacttcagatagtgggtcgatggcgagcggtgcccatacccgtggcggtggcccccttcctggtgcacgcagcactaagcctgctgggaatgttgctgacaagctgatctcagctactgcggttcctttccacttgttggatgcgcaccttgattcgcaaggattattagccttttgtctcggacaaaattattgcttagttggctcctggtacatagaatctagatttgcattaagcagtttagcccacttttgctcaaataatgtcaaggttgaaatagttgtttga

SEQ ID NO: 713 - DNA, 2185 bp, Oryza sativa
caaaagcagcagtggcagcagccaccactttgcacaaaagaagcaaagtaaatggatggccatcgccgttgaggaagggttggtggccatctagagagagagagagaaactagagagagagaggggtgagcagctgagctctgcatctatatacagcactgcatctctctctatttctctctctatatatatctctatctacagtggattttctctctcctctctctctcttgccgttgctgttcgatactgttgttgtcctctcgtggccattattagatggcctcctgctgctgaaatgtgagtgagagctttgctttgcttgcttgctggctggctggctggctagctgggggttggcttcccctcatcctcgtgcatcatccactgtgctcggctcagctgtctgccctgttcttgctttggtggttggacggttagcatcttcctcctcaagctgagatccttcttgacgccattggaggggtcgctgtcgcctgcgtccttgagcctccctgcttttctttttctctctctctctcctcggcgagggagacgacgacgacggtggcggcggcgatgctgagcttcaagcagagccacgaggggttcggccatgtcgccgccgctggagctggaccgcagcagcagcagcagccgtggtgggcggggtcgcagctgctgtacggggaggcgtcgccggaggaggcggcgctgcgcgacggcggccagttccaggtcgtgcccggaggccgcgccgcgctggatccggcggcgccggagccggagaagacggcggtgccggcgatgcccaagagaggaggaggaggggctcctgaggtgctgaaattctcggtgttttcaggtaatttggagccgggagatacaggagagaagaacagagagcactctgccactattgcaatgcaatcgccgttgccagaatacaacggccatttcgagcttggtcttggtcaatccatggtctctcccaattatccttgtattgaccaatgctatggtcttatgaccacctacgcgatgaaatcaatgagtggcgggcgaatgctactgccgctgaacgcgccagccgatgcgccgatctatgtcaacgcgaagcagtacgaaggcatcctccgccgtcgccgtgcccgcgccaaggcccagagggagaacaggctggtcaaaggcaggaagccctacctccacgagtcgcgccaccgccacgccatgcgccgggccagaggctccggcggccgcttcctcaacaccaagaaagaagccaccgccgccggatgcggcggcagcagcaagacgcccctcgcgtccctcgtcagccccgccgacgtagcccatcgtccaggctccggcggccgcgcgtccagcctctccggctccgacgtgtcgtcgccgggaggcgtcatgtacgaccaccaccgccacgacgacgccgacgcggcggaccactacaacagcatcgaccaccacctccgcacgccgttcttcaccccgctcccgatcatcatggacagcggcggcggcggcggcgaccacgcctcacactccgccgccgccgtcgccgcccccttcaggtgggcgacggcggccggcgacggctgctgcgagctcctcaaggcgtgacagccttgaggcggggatctccaggcgtgcccagagctgctgctgatcgatcaccatcagctttggctgcctgtaggcaaatcattcttggctctttacttgcattggggttcttgcaagcaactctcctcgtcacctaccaaaactgtccctgaaacttctctagtgctggggtctcgatcagggatgatgatgtgatggaggagaggcttacccatatgcctgtaaattatggttagtgttctgattaagcaactagtagtacttggtaattactggctatgaattagtagtatggactctggtgtcaggttgctctttgtctgaataaactggagtcgtttgaagctttgcaacagctgtgagtgaaactatgtgcttgcttgcttgcttgttgttggagtgattaagctggagttttgtctggtttgggtgtgtgagaccagtgagatactgtgactgtcgatatcaatgttgatgaatgatttatgaccttgtttatgctaaaaaaatagtgagctagtagagtgtatatgatttggtg

SEQ ID NO: 714 - DNA, 1796 bp, Oryza sativa
tccccgggctgcaggaatcggcacgaggaggatttctacttcttatcctggaggtgtactgtctagatagattaatccatcatgaagtggacatagtattgttgttaatgatattgtagaggccgtacaatagttctttgatttattttatgcttcgatcattttcaactgttcatccagctgagtttggatgtttgtacaacctaatccctaatcattgtatgtggatactatacaaaccgaattcaaggtactaatttatctagtaacttggctttctttatgtgccactgtcagtctgacctgaaaattttctgaacttcaaaataggacagaaaatgtttgtggatcttgagtaatgccttctaataatgataatgctgttgcaagaaatggagaatcatcctgtccaatgcatggccaagaccaactatgattttcttgccaggaataactatccaatgaaacagttagttcagaggaactctgatggtgactcgtcaccaacaaagtctggggagtctcaccaagaagcatctgcagtaagtgacagcagtctcaacggacaacacacctcaccacaatcagtgtttgtcccctcagatattaacaacaatgatagttgtggggagcgggaccatggcactaagtcggtattgtctttggggaacacagaagctgcctttcctccttcaaagttcgattacaaccagccttttgcatgtgtttcttatccatatggtactgatccatattatggtggagtattaacaggatacacttcacatgcatttgttcatcctcaaattactggtgctgcaaactctaggatgccattgcctgttgatccttctgtagaagagcccatatttgtcaatgcaaagcaatacaatgcgatccttagaagaaggcaaacgcgtgcaaaattggaggcccaaaataaggcggtgaaaggtcggaagccttacctccatgaatctcgacatcatcatgctatgaagcgagcccgtggatcaggtggtcggttccttaccaaaaaggagctgctggaacagcagcagcagcagcagcagcagaagccaccaccggcatcagctcagtctccaacaggtagagccagaacgagcggcggtgccgttgtccttggcaagaacctgtgcccagagaacagcacatcctgctcgccatcgacaccgacaggctccgagatctccagcatctcatttgggggcggcatgctggctcaccaagagcacatcagcttcgcatccgctgatcgccaccccacaatgaaccagaaccaccgtgtccccgtcatgaggtgaaaacctcgggatcgcgggacacgggcggttctggtttaccctcactggcgcactccggtgtgcccgtggcaattcatccttggcttatgaagtatctacctgataatagtctgctgtcagtttatatgcaatgcaacctctgtcagataaactcttatagtttgttttattgtaagctatgactgaacgaactgtcgagcagatggctaatttgtatgttgtgggtacagaaatcctgaagcttttgatgtacctaattgccttttgcttatactcttggtgtatacccattaccaagttgccttaaaaaccctccaattatgtaatcagtcatggttttatagaaccttgccacatgtaatcaatcacctgtttttgtaaattgatctataaacgctataggctgctgtgttatctgcatttacttctgtagttagtatttttgtttgtctggtaaaaaaaaaaaaaaac

SEQ ID NO: 715 - DNA, 1470 bp, Oryza sativa
ggaggatagagcacagtcctctcctcttccccgtgctccccatttctgcttcttttcccacaaatttctctctctatctcagaaaggattcgggagacttgaagagaggagctcgaagcgggacaggagagagaggctaattatagaagtacacgaagaaaaatggtgcctggaccaaagtgagaccatctcataatgctaatgcttttgcgacaaatggaagatcatcgagcccatactacgcccaactatgattttttctctggagattatcagatgaagcagttaggtcataagatgtatgatcaagattccccgtcaagcgattctggacagtcacaccaagaagaatctgccatgaatgatagcagtccaaatgagcgacatacctcaacacaatctgacaatgatgatggtcatcagatgccagatcaggacaaaacaaagtcagtatcatcgttggggaatccaggagctttgcctccaaagctcaactatagccaatcctttgcttgtattccttatacagctgatgcatactatggtggggtcttgactggatattcttcacatgcaattgttcatccccagcaaaatggtacagctaactcccgggtgccgttgcctgttgagcctgcagcagaagagccaatatttgtaaacgcaaagcagtaccatgcaattcttaggaggagacagatacgagctaaattggaggcccaaaataagttggtgaaaggtcggaagccatacctccatgaatctcggcatcgccatgccatgaagcgagctcgtggatctggagggcgcttcctcaacacaaagcagctcgaggagcagaagcagcaacaggaggaggaggccgcatccggtggcgcgagctctggcaataggacatgccttcagaatggcaccggtagcgcgccttcagcttcctctccctctgaaatcgcgagcgtctcaaccagcagagaattccttggtaaccatgagcagagccacttcccctcagctggcttccttcccacaatgagcttcagagcgcagaatggcggagatgggaagctggtcgcgaacgccattcaccagcgcgtttccatgatgaggtgaggtgaagaggggtgaagtgggttcagctcagcaccatcactttggctctctccctgctggtggcaattcatccttggcttatgaaaataccttatgggaaaaaaaaaagtagtttcatcctcaaatggaccaaacatgtgtggctccattttaagttttcctgtaactaaaagcactgcaatgatcaactgactgttggttctgtttgtggatgcttatatctgtacttgctgtatctaatactgaactctaagttgaaaccctgaaactgatggtccccgtgaatattgtagcttgcattttatctgatttttagttcctaaaaaaaaaaaaaaaaaactcgagactagttctctctct

SEQ ID NO: 716 - DNA, 2694 bp, Oryza sativa
gaggacgagaccgagagcgcacaaggctttcttctctccatcttcgctgttccacagtccacacccacgcacacaagcaagcggcctcatctgttttattgtttttcttgatccccttccctccatatctctctcgcgccgatcgagaggggggcgggcggcgggcggcggcgcgcggcgggagcatgcgcgagtaggttggtagatgagggcggcacccttcagtgccgacgggaacggggcggcggagctcgcggggagcatagcggcgctgctttggccggaggacaagggcggcggcggcgggggcggcggggggtcgttgctggtggagccgaggtcggtgctggactgcagggggagcccgagcccgcccaactccacatcgacgctgtcttcgtcccatggtagcggcgcggcggattctatatctaccggcgtggcggcggtttcggagagcagcgcagccgcccgccgaagccaccagatgggcggcccccggcgaacacggcggcggcggtggcggtgagctgccgcccataccgggggccctggatgtgggcttcgtcgcggaggagagctgggacgccatgctcggcgacgccgcggcggcggcaggccaggagcagacatttttgaactggatcatggctgcccccggcgacatggaaccccaggcgccggggctctcgcagcagcagctcctcgccaatgccgccgggttcgggttcccgctgcagcatcaccccggtggcgtctcctcgccagccgccctcgcctccgacctgtcgtcctccggcgggaggtcgctcacaagcagcagcggcagcaatagcaaggccacctccgctttcggcctcctgtcgcccgaagcggcgctccagccgccgccggcgactactgcgcctttccacaacggcgctgacatgaagccccctctccttggcttgccatcacccacactactcctcaaccagcatcagccgacgccggcctccaccttgttcatgccgttcccctccttctccgaccatccccgggcgcaggaattcggcacgagggcgaagcgccaccactccgtgcccgacaatctcttcctcctccacaaccagccccagccaccgccgccggcgcccgcgcaatgcctcccgtttccaacgctacatagcgcggtacccttccagctccagccttcgatgcagcatccgcgcaacgcgatgaagtcaaccgcggcggcggcggcggcgcagcagcaacacctcctggacgagcttgcagcggcggcgaaggcaaccgaagtcggcaactccataggcgcgcgagagatattggcgcggctcaatcagcagcttcccccaattgggaagcctttcctccgctccgcctcctacctaaaggacgccctcctcctcgcgctcgccgacggccaccacgccgccacccgtctcacgtctccgctcgacgtcgccctgaagctcaccgcttacaaatccttctccgacctctcccccgtgctccagtttgccaacttcacggtaactcaggcgcttctggatgagatcgccagcacaaccgcgtcttgtatccgcgtcattgatttcgacctcggtgtcggcggccagtgggcttcgttcttgcaggagcttgctcaccgctgtggctctggcggtgtgtccttgccgatgttgaagctcacagccttcgtctcagccgcctcccaccacccgcttgagctgcatcttactcaggataacctctcacagtttgctgctgatcttggtattccatttgagttcaatgctattaatctcgacgcatttgatcctatggaactcattgctcctacagctgatgaggttgttgcagtaagcctcccagttggttgctcagcacgcactccactcccagctatgcttcagttggtgaaacagcttgctcctaagattgtggttgctattgactatggcagtgatcggagcgacctcccattttcccaacacttcttgaattgcttacagtcttgtctatgtcttcttgaatcacttgatgctgctggcactgatgcggatgctgtcagtaagatcgagaggtttctgattcagcccagagtggaggatgcagttcttgggcggcgtagagctgacaaagcgatcgcttggcggacagtgctaacatcagcagggtttgcacctcaaccactcagcaaccttgcggaggcacaggctgactgcctcttgaagcgggtgcaggtccgaggcttccatgtggagaagcgtggagcaggccttgcactctattggcagcgtggcgagcttgtatccgtctcagcatggcgatgctgatcacacctgcctcgaccatcatgattcctacaccatttgcaggcatgtttaactccagtaatatgaattttgtcttgcaatttaaacattgcaaagaaattattatcatggttgttgcacactctgttgtttattaggtaggcctaatggatttggcaatcttggtatgagtgtctctgtagtgtgtgaccagtggctatggcctctagggtcttaccactatgttgttgctctccgctcaattggccacttcatgttcttggaaacatttcgttgtgaatagataagataatttggcaaaaagaatgtccttatgacaaaaaaaaaaaaaaaaaaaaaaaaaaaagaaaag

SEQ ID NO: 717 - DNA, 2052 bp, Oryza sativa
atggccgccgcgcctgcgccgaagctgcctccgttcccggcgggcgggttcgtccccgccctgaagccgaaggcggaggcggcgaacgacgaggccgccgctgcggtcgaacagctagccgaggcggcgaagctggccgaggccggcgacgccttcggcgcccgcgagatattggcgcggctcaattaccggctccccgccgcccccacggccgggacgccactgctccgctcagccttctacttcaaggaggctctgcgcctaacgctctcccccaccggcgacgccccagcgccatcggcgtcgacgccgtacgacgtggtcgtcaagctcggcgcctacaaggccttctcggaggtgtccccggtgctccagttcgcgcacctcacctgcgtccaggcggtgctcgacgagctcggcggcgccggatgcatccacgtgctggacttcgacatcggcatgggcgagcagtgggcgtcgctgatgcaggagctcgcgcagctccgcccggccgccgcgctcaaggtgaccgcattggtgtccccggcgtcgcaccacccgctcgagctgcagctcatccacgagaacctctccggcttcgccgccgagctcggcgtcttcttccacttcaccgtcttcaacatcgacaccctggaccccgccgagctcctcgccaacgccaccgcgggcgacgccgtggccgtgcacctccccgtcggccccgcccacgccgccgcgacgccggccgtgctccgcctcgtgaagcgcctcggcgccaaggtggtggtctccgtcgaccgcggctgcgaccgctccgacctccccttcgcggcgcacctcttccactccttccactccgccgtctacctcctcgagtccatcgacgccgtgggcacggacccggacaccgcgtccaagatcgagcggtacctcatccaccccgccatcgagcagtgcgtcgtggccagccaccgcgccgcctccgccatggacaaggcgccgccgccgccgtggcgcgcggcgttcgcggcggcggggttcgcgccggtgcaggcgacgacgttcgcggagtcgcaggcggagtcgctgctgagcaagcttggctctgcttctgcttctgcttgtgcagatgcagagtgccatgtcgcaatggtgttgtactgccctcttatcaaagaaagagagagaaaacgatggaatgtacacctggttattgtattagttgaactaaacacaccccaagctgaaaagaaccaaagggaagtaggaggatatgggggagagaaaaataaaatcctgtcagaatataatctgctgcctctgcctgtgctggagatgcaaaggaaggggggcaatcatggtgtaaagcgtccatgctttactgaaatggcggcaaagcatcttagggtaaggacaggcacatcaagaacagcagcagcaacattggatgggtacaccactttaacctgggactcagctccagaatggccatggcaccgcatgcacaaaccggataggttgagatgggctcactggagagtcactggagagccacagtgtgcagcaggagcagtagcaataggtcaggcaagtggccacactggagtacgggacactgcaggagcaaactggcaagagacctgcatagtagttacagagatggatgttaagcttgctgataaattcagaaaaaagtggtaccacagttcaaaacttcaaaaaagaaggtgcactgttggtttaattaagcaggacttgaaagttcaaaaccagggaggggaatcagaagccagtagacacaaaggcctccagatctcattcagacaggttcagatttcattgcggaagccaaataggaaatgcaagcatagtggccagactgtaaagttgatcaatgagaattgctattacctctccactaaaagaaacaacttaaagataaaagaggtcaactacatatgctatatttatgctgaagaattgcatccactcaaagtcatgttcagaaatacacaagcaaagatatgccaaatagatgtccaaaaatcctag

SEQ ID NO: 718 - DNA, 4239 bp, Oryza sativa
atggaggaggtggagaagaaacgggaggagagcgagaagcgtcgggagctgtcggaagagaagagccgatctgagtttttggctctcaaggtggcggtggaatcccgaatgccggtggtggagaagcgcgtggatgatttgcacgtttcggtggtgggactccaagatcaagtcgacaaactccagtccttggtgcagcagccacctcgtccttccccttcttctccgggttcgcccgatggtatgcaaactccgccccaatttacttcgctcccctctgctctggaacagtctgcgtttgcctctgctcttttgggtgcttcgggaattgggggtaatgttccacctatgtcttgcccgcaattcaatggtgatagacctcagctctggaagagtaattgcgaggagtactttgaggtttatggtgttcatcctaagaattgggtgcgtgtggctggactgaattttactggcaacgctgctttttggttacaatcggtgcgttccaaactggtcggggttacttggcaagagttctctgatcaagtttgtcttcgtttcactaaggataggcaggaggtcttgattcggcagtggtttcacattgttcaggattcttcagtttctgattatgtggagaaattcgatggtattatgcatcagttgttggcttatgatagttctttgtctctgaattattttgttaccaagttcgtggaaggactgaggaaagacattagatctggagttttgatgcagaaacctcaagatttggatacagcgtgttcgttggcttttttgcaagaggaaatactagaaggaagtcaccctgctgtgtacaggaaacctgagccgattttgttgtctaaaaattttgctcgccaacctgcacctgtttctcctatgtccaaccatcctcaaggttctgtgttggaggataggaaacagtctgaattctcgcagtctcgctctgataagttttctgccttgaaatcctacaagcgtgctaaaggcctttgtttcacgtgtggtgagtgttggagcagagagcataagtgtggctcctcggttcagttacatgttgttcaggaactcttagctgcgttgcaggacgatcagttaaaccatgagtccgtcgatactgtatctgaacctgctgaaccagttttgatggctatttcttatcaggctgttactggtactgaatccttgacttcttttcggttaaatggctgggtacaggggtatgaattactcatgttagtcgattctggtagttctcattccttcattgatattactgtggcacaaaaacttcagggtatccaatgtttacaacatgctgcttcagttaaagttgctgatggtggtgtgatatcatgctctcagtatattcctggttgtgactggtggactcagggtcaaatttttaaaactgactttaaggaagtttccactgccaagttaggtcacattcctcctgaaattcaatctcttcttactgaattttctgccctatttgatgatcctcaaggcctgccacctaagagagcttgtgaccattccattccactgaaatcacatgctaaacctgtcttcctcagaccttatcgtcataaccctgcacggaaagatgaaatagagaagcaggttaaggaaatgttgttgtcaggggtcattcaacccagcaatagtgcattttcttccccagcattgttagttaagaagaaggatggtacctggcgcttgtgcattgattatagacagttgaactccatcactatgaagggtaaatttcctatgcctgttatagatgaactattggatgaattgtctggatccaaagttttttccaagctggaccttagggctggttatcaccagatcagattggtggagggtgaggagcacaaaactacttttcaaactcactctggacattatgaatatcgtgttatgtcttttggccttactggagctcctgcaacatttcaaggcgccatgaatgatactttggctcctgtgttaaggaagtttgctcttgtgttttttgatgatatacttgtatacagccctgatttagtttctcatgtccaccatcttcgacaagttctgcagttgttgactgagcatcagtggaaagttaaattgtctaaatgttcttttgctcaacatcaattgtcatatttaggtcatattatcagtgatcaaagagtcactactgatcctgctaagattgaggaagtggttaattgggcagttccaaaatttgtcaaaaagctcaggggatttttgggtttggcaggttattataggaagtttgtcaagcaatttgggatcctttgcaggcctttgaccaacctgttaaagaaggatgttccttttgtctggtctgtggaggctgatcaggctttcaaggctcttaagcaagctttagtatctgctcctgtgttatctcttcctgatttttctttgcctttcactattgagactgatgctagtgatgaaggtattggtgctgtgttatctcagtgtggtcatccgattgcatttcttagtaaggccttgggggttaaaactaagggtctttccacctatgaaaaggagtatttagctattttattagctgtggaccattggagatcttacctgcagcagcaagagtttgtcattttaactgatcaccatagtttaatgcacttgaatgaacaaaggctgcacaccccttggcaacacaaagcttttactaagttgttgggccttcagtttaagatttgctacaggaagggatccagtaatgctgcagctaatgcactttctaggaaatatcctgaagagttatctgaactacatgtggtttccagttgcagtcctgtatggcttcaggaggtttctgatggttatcttcaagatgtcttttctgctcaacttttgactgacttgactcttaatgctgagtctcggcccaatttctctttgtgtaatggtgtccttcgctttaaaggcagagtctggatagataacaatccatctgtgcaggataagattatctctgcgttgcacagtagtcctttgggggggcactctggttttcctgttacttatagtaaaatcaagtctctttttgcttggcccaagatgaagaaacagattcatactgctgtcaaaacatgtggtatttgcatgcaggccaaaccagatcactctaaataccctggtcttcttcaaccccttcctgtccctgatggtgcatggcagattatcaccatggactttattgaaggtttgcctaagtccggtcaattcaactgtattttagtggtggttgacaagttttccaagtactctcatttctttccattgtcccatcctttttctgctattgatgtggctcaatcttttatggtcaatgtttacaagttacatgggttacctaagttcatcatttcagaccgcgacaagattttaactagccacttttgggagcagttgtttttgagaaccggcacacaattgcaactaagcaccgcttatcacctccagacagatgaacaaactgagcgtgtgaaccaatgtttggaaatatatctgcgatgttttgttcatgctgttcctcataaatggagttcttggttgtatttagcagaattttggtttaacacttcttaccattctgccattcttcagtctccatttgaagctctctatggctatcctcctggtcattttggtataagggatgatgcctgctcagtacctgatttgcatgagtggttaaatgaacgtaaggtgatgactcagttactgaaacaacacctaaatcgtgcccagcaacaaatgaagctgtatgcagataaaaagtgcagtttcagagaattttctaatgtagattgggtctacttgaaattgcaaccttatattcagtcctctgtggcaaaaagagcaaatcataaactatcattccgttattttggtccttttcaagttttatatcgggtgggcaaggtggcttataagttgtctctttctgcagagagctccattcaccctgtttttcatgtttcacagcttaagcatgctgttgggttcaggcattctgttcaaccgtgtttgcctgcatgttctgaccttaaagttcctgtggctgtcttggcttctcgtcagatcaggaaaggtaactctgtgaaagctcaagttttaattcggtggtctggagatgttacaggacaggaaacttga

SEQ ID NO: 719 - DNA, 3255 bp, Oryza sativa
atgatgtaccgggagaccttcgccgacgaggtcggacacatcaggaagtcgttcgagatgctcgagggagctaatgtccagcaagttattcctgaagctgctggaggctatgctcaagaccgggaacaggatgaacgttgggacctcctgcggcggcgccatggcgttcaagctcgaagcgctgctcaaattcacctatgtcgagggcaccgacgggaagccacgctgctccacttcgtagtgcaggagatgaccctgtcgagcgccgccgaggcggcggacattgccgcggggctcgccgccgagctcaccaatgtcaggaagacggcgaccgtggacctggacgtgcttaccacctcggtgtccggcccgtcgcacggcctgtcccaaatcaaggagctgattgggagtgacctgtccggctatgagaggaaccagtgcttcgcgcgtggccttcatgtgactacactgttcacattatttgcctttccgctgttgaagttagactttggatctgaatctatacggaagagtggtagatccagtgaaccacctctttctcctgaggaagaggctaagttcgaggcatcggattgtctgttccgtggagcattgatcagtgtactcgctgacaatatagtggacgtgtacatgcacatgccttctgggaaggacatgtgggatgcacttgaggccaagttcggagtttctaacgccggcagtgagctgtatgtcatggagcagttctatgactacaagatgttgccggacaagtttgtggcgggtggcattattgccaaattgccaccttcttggtcggactttgccacttctctaaagcacaagagacaagagttcagtgtttctgatctcattggctctttgggtgttgaggagaaggcgagggcaacggacatccgggaaaaaaaggttgagggaggttctagtgccaatatggtacagaaaaagaaccctcatgcatcctacaacaacaagaaagtcaagcctgatgtcaaacccaaggctgcaaccaactttaagaagaaaggcaagggaaaagcaaagggagactgctttgtgtgtggcaagtctgggcattgggccaaggactgtcctgagcgcaaagacaggaagtctgccaacatggtcattggcgagggcggaggaacatcggggtacggtaaaatattacctacagttctctctgtttttcactcacctgattggtgggtggacactggtgctaatattcatgtcgggagaggttcctccatgttgatgggaaacgggtcgcttgcggctgttcatggtattggtacggtcgatcagaagtttacttcgggaaagaccgtgcagctgaagaacgtgcagcatgtcccttcaataaagaagaatcttgttagcggctctctactttgtagagaaggttttagacttgtgtttgagtccaataaatgtgtcgtatctaaatatgggacttttgttagaaaaggttatgacagcggaggcttgttccgcttttctttgaatgacatgtgtaataatcataatgttgtgaaccatattagcgagaatgatgagtctaatgtgtggcattcgcgactctgtcatgtgaatttcagttgtatgacgcgcttagctaacatgagtttaattccaaaattcactttgatcaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattacactagattttgttatgtgtatatattgaaaagaaaggatgaagcattgcattactttaaaatctataaagctgaggtagaaaaccaacttgaaaggaaaatcaaacggttgaggtctgatagaggtgaggagtatttttctaatgagtttgcatccttttgcgaagagtttggaattatttatgagaggatgcctccctattcaccccaatcaaatggggtggccgaaagaaagaaccgtactctaactgagatggtgaatgccatgttagagactgcggggctttccaaggaatggtggggtgaggcagttttgactgcgtgtcatgtcctgaataaaatttcaatgaagcataaggaagtaacaccattcgaggaatgggaaaggaagaaattaaatctctcatacctacgaacatggggctgtttggccaagcactttgcaccgatagaacacaatgatcaaacgcctgagaaaaatcctgaggaggacaacattgtagacactcacaagagtaagagacaaagggttgcaaaatcctttggagatgactacattgtataccttgtggatgacaccccaagaaccatagaagagacatattcatctcctgacgctgactactggaaggaaataatggatgttaagacagctttcttaaacggagagctggaggaggagatctatatggatcaaccagacggccttaatgtgattgaggaggtcaaggactatctgtacaagagttttgaaatgaaggatttgggagaggctaatgttattcttaacatcaaactacaaagaggagatgagggtgggattacacttgtgcaatctcactatgtggacaaggttttgagtcgctttggatatagtgactgtaagccagctcctactccttgtgatcctagcgtgctattaaggaaaaaccgaagaatagtaagggatcaactgagatactctcaaatcattggttcattgatgtacttggctagtgcaacgaggcctgacatctcatttgctgtaagcaagctgagccggtttgtctcaaatccgggagatgatcattggcaggctctggaaagagtaatgcgctatctaaagggcactatgagctatggaattcactataccgggtattcaaaagtactagaagggtatattgactcaaactggatatctgatgctgatgagataaaagtcacaagtggatatgtgttcacacttggaggtggtgttgtttcctggaagtcttgcaagcagaccatcttaacaaggtcaacaatggaagcagaacttacagcactagatactgcgacagttgaggccgagtggcttcgtgaactcctgatggatttgccggtggttgaaaaaccagtgcgcgccagctatcctaatgaactatga

SEQ ID NO: 720 - DNA, 2767 bp, Oryza sativa
gataggtgtccatagcaagcagagcaggagcagagccaactgcacaaggcaaggcagggggcctctcctcgctgttctactgctgctatactctggcatcgcgtcgcgcgcgcaagcaaaagggtagttcctcaatcaaacgctccaagagaaatcaccccgccacgccacgccgcgccgggctgggctgctgctcccagatctcgccgagcggggcgctcgattatgtgggattaggtagatgagggcggcgctgttcggtgccgagaggagcggggtagtggaccacggcggcggcgataaggaggagctgttttggccggcggggaagggggggctggtggtggtggagccgaggtcggtgctggactgcacgcgcagcccgagcccgccgtattccacgtcgacgctgtcgtcgtccctgggcggcggctcggcggactcgaccggtgtggcggcggtttcggagagcagcaccgccgccgccggagccaccaaatggggagccccaggcgagcatggtggcggcgggaaggaggagtggggcggcgggtgcgagttgcccccgatacctggagcactggatgtggggctcgtcgggggcgagggctgggacgccacggccacgctcggcaacgcagccgggccggaccagtcgttcttgaactggatcattggggccgccggcgacctggagcagcctggtccgccgcttccagtgctccagcagccgcttattgacaatgcggggttcgggatccccggccgtggacaccatgggcttctctctgggatcaccccctcagcggcgtcgcctccgacctctcggccctccggtgcgcacactgccaccggggggtggcggcaaggcctcattagggttcggtctcttctcgccggaggccacctccctcgagcagccgccgccttcgatgctgtttcacgaaggtatcgacacgaagccccctcttctgggtgcgcagccgcaatttctcctgaaccactaccaaccccagccacccaaccccgccgcagccttgttcatgcctctcccgcccttccccgagcacaatcaccagtcgccgcatctccagccaccgctcaaacgccaccacgccattccagatgacctctacctcgcccgtaaccagcagcagtcatccgcggtggcgccaggtctcgcctattcaccaccgctacatggcccggctccgttccagctccatccttcgccgccaccgattcgcggggcgatgaagtcgacggcggcggaggcggcgcagcagcagctgctggacgagttggcagcggcggcaaaggcaaccgaggctggcaattccgttggcgcgcgagagatattggcgcggctcaatcaacagcttccccaacttgggaagcccttcctccgctccgcctcctacctcaaggaggccctcctcctcgcactcgccgacagccaccatggctcctccggcgtcacctcgccgctcgacgttgccctcaagcttgcagcatacaagtctttctctgacctgtcacctgtgctccagttcactaactttaccgcaacacaggcgcttcttgatgagattggtggcatggcaacttcctgcatccatgtcattgactttgatctcggtgttggtggtcagtgggcttccttcttgcaggagcttgcccaccgccggggagctggaggtatggccttgccgttgttgaagctcacggctttcatgtcgactgcttctcaccatccactggagctgcaccttacccaggataacctctctcagtttgccgcagagctcagaattcctttcgaattcaatgccgtcagtcttgatgcattcaatcctgcggaactcatttcttcctctggtgatgaagttgttgctgttagcctccctgttggctgctctgctcgtgcaccaccgctgccagcgattcttcggttggtgaaacagctttgtcctaaggttgtcgtggctattgatcatggaggtgatcgtgcagaccttccattctcgcagcatttcctgaattgtttccagtcctgtgtgttcctccttgactcgcttgatgctgctggtattgatgctgattctgcctgcaagatcgagaggttcctaattcaaccaagagttgaggatgcagtgattgggcggcacaaggcgcagaaagctatagcatggaggagcgtttttgcagcaactgggtttaagcccgttcagctcagcaacctcgccgaggcgcaggcagactgcctcctgaagcgggtgcaggtccgaggattccatgtggagaaacgcggagctgctcttacgctctactggcagcgtggggagcttgtatccatatcatcttggcggtgctgatcagccataagcttcactccaccaaggttccaccaccgtttgcaagcatcgaccactccagtaatgtccatttattcttgcaattaaatgttgcaaatgaaattgttgtcttgagctgttgaactcttcatattgcttttcgttgcagcttattagctagcctagtggatttaggaatattggtgtcagtctctatagctaatgatgttgctttaggttgttgccatgctctgctcaattagccatgatcatctcattggaaacactgcttatgagtagagactagagggtaatttaacctatcaaatggttgtgtggtacagaattaatattatactgctgttgctctgtaaaaaaaaaaaaaaaaaaaaaaaaaaaaaaaaaaaaaaaaa

SEQ ID NO: 721 - DNA, 2117 bp, Oryza sativa
atgcaggacgcgctgctggggcggcgctgccagcggcgggcaggagccgggagccagcggcggtgggacagcgggcgggcgaggatcggatcccctttgcgagctcgcgacttcgagacggcggcgggcagcggagacggcggcgagcggcggagacgagggcgtggcgcggcggccctcgagcggtggagatgttgggagtggcagcagcccgattccctagctgctgccgcttccgccctagatgagctcgacgtgtcgagcaagacgttgttgggcttgacgtcgccgtgcacgaccggcggcttgacgacggagtggaggataggagtactctacatgctgcctatgatcaatattgccctcatgtcctcctcctcttgccatccccacaaccccaccaccctgccgctgccggagccggacagcagcaagtcgccggagcccacctccgtgctctacaaccgcagcagcccgagcacctccctcggctcctgctcctccaaaccaccggaggaccctcctccccccatcgccgccgacgacgactgcgactgggacgccgtcgtcgacatgcacatgcacatgctcgcccccgcccccgcccccgactcctccttcctccgctggatcatggataccggctatgccgacgccgacacctttcccgaccacccctccttcgactccgacctgctccaactccccatgcccatgccctctgaccatcctcctcagccgctcgtcgacgacctcctcgacgccgcacgcctcctcgacgccggggactccacttccgctagggagatattggcgcggctcaatcatcgcctcccctctcttccgtcgcctccgggccatgcccaccctccgctcctccgcgccgccgccctcctccgggacgcgctcctcccgcccaccgccctccccgtctcctctactcccctcgacgtcccgctcaagctcgccgcgcacaaggccctggcggacgcctccccgaccgtgcagttcaccaccttcacatccacgcaggccttcctcgacgcgctcggctccgcgcgccgcctccacctcctcgacttcgacgtcggcttcggtgcccattggccgcctctcatgcaggagctcgcgcaccactggcgccgcgctgctgggccgccgccgaacctcaaggtgaccgcattggtgtcgccggggtccagccacccactcgagctccacctcaccaacgagagcctcacgcgcttcgccgccgagctcggcatcccgttcgagttcaccgccctcgtgttcgaccccctcagcagcgcgtccccgcccttgggactctcggccgcgcccgacgaagcggtggccgtccatctcacggccggctccggggccttctcgccggcgcccgcgcacctccgtgtcgtgaaggagctccgccccgccgttgtggtgtgcgtcgaccacgggtgcgagcgcggcgccctcaacctcctgcagtcttgcgcggcgctgctggagtctctggacgcggcgggcgcgtcgccggacgtggtgtccaaggtggagcagttcgtcctgcggccacgggtggagcgcctcgcggtcggcggcggcgacaagctgcctccgccgttgcagtccatgttggcgtccgcggggtttgcggcgctgcaggtgagcaatgcggcggaggcgcaggcggaatgcctgctgaggcgcacggccagccatgggttccatgtggagaagcggcaggcggcgctggcgctgtggtggcagcggtcggagctcgtctcggtgtcagcgtggcgatgctagctgcctctgcctggtacacttgtactacaaatgtttggtgttcattgatcttgaatattttcagctttgggtaaattgatcaaaccaaagctgcttgtgatatgttagcactagtagtagtaattgggtaattatttcttgcctgggagaattcatgctccatggcatgcttgtacaatttgtatggcaatgacaaaattgggagtgctcaagagtgcaagcccccaaccttgtgattcaacagataaaaaaaaaaaaactttcttttgtgcacatctctgatctaatatacagagtagttctctttt

SEQ ID NO: 722 - DNA, 1081 bp, Oryza sativa
  misc_feature (185)..(185): n is a, c, g, or t
  misc_feature (291)..(291): n is a, c, g, or t
  misc_feature (298)..(298): n is a, c, g, or t
  misc_feature (327)..(327): n is a, c, g, or t
  misc_feature (330)..(330): n is a, c, g, or t
  misc_feature (333)..(333): n is a, c, g, or t
  misc_feature (401)..(401): n is a, c, g, or t
  misc_feature (460)..(460): n is a, c, g, or t
  misc_feature (495)..(495): n is a, c, g, or t
  misc_feature (927)..(927): n is a, c, g, or t
  misc_feature (1014)..(1014): n is a, c, g, or t
  misc_feature (1039)..(1039): n is a, c, g, or t
  misc_feature (1053)..(1053): n is a, c, g, or t
acttcttmgacgcsgkacgcttcttmgacgccggggartccarttccgttagggagatattggsgcggctcaatcatcgcrtcccrtrtcttccgtcgccgccgggccatgcccaccrtccgttcttccgcgccgccgccttcttccgggacgsgttcttcccgcccaccgccttcccggtrtcntttactcccctcgacgtcccgctcaagctcgccgcgcacaaggccrtggcggacgccwcccsgcaccgtgcaywwkaccaccttcacatccacgcaggccttcctngacgcgntcggctccgcgcgccgcctccacctcctnganttngacgtcggcttcggtgcccattggccgcctctcatgcaggagctcgcgcaccactggcgccgcgctgntgggccgccgccgaacctcaaggtgaccgcattggtgtcgccggggtccagccacccantcgagctccacctcaccaacgagagcctcacgcgnttcgccgccgagctcggcatcccgttcgagttcaccgccctcgtgttcgaccccctcagcagcgcgtccccgcccttgggactctcggccgcgcccgacgaagcggtggccgtccatctcacggccggctccggggccttctcgccggcgcccgcgcacctccgtgtcgtgaaggagctccgccccgccgttgtggtgtgcgtcgaccacgggtgcgagcgcggcgccctcaacctcctgcggtcttgcgcggcgctgctggagtctctggacgcggcgggcgcgtcgccggacgtggtgtccaaggtggaycagttcgtcctgcggccacgggtggaycgcctcgcggtgggggtcggcggcggtccaccgttgcagtccatgttggcgtccgcggggtttgcggcgctgcaggtgaacaatgcggcggangcgcaggcggaatgcctactgaggcgcacggccayccatgggttccatgtggaayaacggccggcggcgctggcgctgtggtggcancggtcggaactcgtctcggtgtcancgtggcgatgctanctgcctctgcctggtacacttgtactac

SEQ ID NO: 723 - DNA, 2580 bp, Oryza sativa
acacccctccccccctcctctcctctcctctcctctcctcctcacaaacataaacacaaacacatcaagagcaagaacaacaagagagagagaaatcaaactccaccacccaccacgacatcgagctcgcaagcaagaacaagattgcaagaagaagaagttgttgttggtcgaggcgaggaggaggaggaggaagaaggagtttgtgtgttggtgttatgaggtgttggattagatgagaggaatgccctttggtgggagcgcgcgagaggggcacgcggggacactgctgcaacaccacctcatacacggcgttggcctcgccgcggccggcaagctcgtctcctcctcctccgccgccgccgccgccgccggagcaggtgggttctgggagccaaggtcggtgctcgaccaccgccacagcccgagccccagcccgcctacctcggcttccacgctgtcgtcgcctctcgccgacgtggcggccctcgccggcgccaacgccaagaacgtctccgtctccccgccgccgccgggatggggaacgggaggaggaggtggtgggggggaggaggtggtggcggcgaaggaggagtgggtgcaccagctcacgccgcttgatatggggctcggcgccggcgaagggtgggatgccgccgggaacgtgctgggtcatggaccgccggtgctcgagctcgaccatggcggcggcgcggcgcgctgcgcccgccgcgttcgggccgttcgcgccgccgcccgcggcaaggacacgaagcccgtggtgccgttcgcggcggggcaccccccgccgaacttcctcctccaacaccaccaccaccacccgcagccgcacgcggcgttcttcggcgcccaccacccgtcgttcgacgcggcgccgccgccttccaagcggcaccacccgatggccgccgcgcctgcgccgaagctgcctccgttcccggcgggcgggttcgtccccgccctgaagccgaaggcggaggcggcgaacgacgaggccgccgctgcggtcgaacagctagccgaggcggcgaagctggccgaggccggcgacgccttcggcgcccgcgagatattggcgcggctcaattaccggctccccgccgcccccacggccgggacgccactgctccgctcagccttctacttcaaggaggctctgcgcctaacgctctcccccaccggcgacgccccagcgccatcggcgtcgacgccgtacgacgtggtcgtcaagctcggcgcctacaaggccttctcggaggtgtccccggtgctccagttcgcgcacctcacctgcgtccaggcggtgctcgacgagctcggcggcgccggatgcatccacgtgctggacttcgacatcggcatgggcgagcagtgggcgtcgctgatgcaggagctcgcgcagctccgcccggccgccgcgctcaaggtgaccgcattggtgtccccggcgtcgcaccacccgctcgagctgcagctcatccacgagaacctctccggcttcgccgccgagctcggcgtcttcttccacttcaccgtcttcaacatcgacaccctggaccccgccgagctcctcgccaacgccaccgcgggcgacgccgtggccgtgcacctccccgtcggccccgcccacgccgccgcgacgccggccgtgctccgcctcgtgaagcgcctcggcgccaaggtggtggtctccgtcgaccgcggctgcgaccgctccgacctccccttcgcggcgcacctcttccactccttccactccgccgtctacctcctcgagtccatcgacgccgtgggcacggacccggacaccgcgtccaagatcgagcggtacctcatccaccccgccatcgagcagtgcgtcgtggccagccaccgcgccgcctccgccatggacaaggcgccgccgccgccgtggcgcgcggcgttcgcggcggcggggttcgcgccggtgcaggcgacgacgttcgcggagtcgcaggcggagtcgctgctgagcaaggtgcacgtcagggggttccgcgtcgagaagcgcgccggctcgctctgcctctactggcagcgcggcgagctcgtgtccgtctcggcgtggaggtgctagaaagccctcgccgccgtcgccgtctccggcgagcggcgcagccgtggagccgacgtatcaaggagccgcggattttagttagggactaatgatcctgctacttcttcctctccaagtgaaagtcaagtgtttttttaccctttttgtgtaacttttttttactccttttttcttcttcttctttgtgttgctgtaatgatctcagctgagctgatcagtgagctgagtgtcctaagattgtcgtgtcaccttgcagcttggctctgcttctgcttctgcttgtgcagatgcagagtgccatgtcgcaatggtgttgtactggtacagtagctggcgcattctacttcaccatcatccatccatccatccccctgtgttactactcgattccccgtgaaaatcaatggctatggcatttgaaaaaaaaaaaaaaaaaaaaaaaaaaaaaaaaaaaaaaaaaa

SEQ ID NO: 724 - DNA, 1449 bp, Oryza sativa
atgcgcagcagcagcagcaaggccacacccacaacctcccctgcttttcgcgtcctctgctctcctcctagtgccaagagtccaagacccaacaagggggaggacggaggaggcgaggcagaggcatctcaccgaagggggaagggcgacgccatgtgggacctcaatgactcgccggcggccgaggccgcgccgccgccgctgtcgccgtccgccgacgactccggcgcctcctcgtcctcggccgccgccgtcgtcgagatacccgacgacgccgacgacgactcggccgctgtggttgtcgtcacgcgccagttcttccctccggccgtcccgggcggcggcggcgaccccgcccccgggaacgcgcgcgccgggtggctccgcctggccggagccgccccgccggtcgctgcaacggggccggcggcgtcggcggcggtgtccaagaagagccggcgcgggccgcggtcgcgcagctcgcagtaccgcggcgtcacgttctaccgccgcaccgggcgatgggaatcgcacatatgggattgtggcaagcaggtctatttgggcggatttgacactgctcatgcggcggctcgggcgtacgatcgggcggcgatcaagttccgcggcgtggaggccgacatcaatttcagcttggaggattacgaggatgacctgaagcagatgagcaacctgaccaaggaggagttcgtccacgtgctccggcggcagagcacggggttcccccggggaagctccaagtacaggggcgtgacgctccacaagtgcgggagatgggaggctcggatgggccaattcctcggcaagaagtacgtctacttggggctgttcgacaccgaggaggaagctgccagggcgtacgaccgcgctgccatcaagtgcaatggcaaggatgcggtgacgaacttcgatccaagcatttacgccggggagttcgagccgccggcagcggccacgggtgatgccgccgagcacaacctggacctctcgcttgggagctcggcgggctccaagaggggcaacgttgacggtggcggggacgacgagatcaccggcggcggtggcggtggcgcgggctccgaccagcgcgtccctatggcgttcgaccttgactggcaaacggcggcggcgaggagcaccaaagctaagttcttgagcaatggtgatccggggacagcgggaggcctgtcactgacgatcggcgcaggcatggccgggcactggcctccccagcagcagcaggggtggggcaacgccggcggcatgagctggccgcacccgccgcacccgccgccgccgccgaccaacgccgcggccgccgcaaccgctacagcagctgcagcatcatcacgattccctccctacattgcgacgcaagcctcaacctggctgcagaagaacgggttccattccctgacccggcccacc

SEQ ID NO: 725 - DNA, 2235 bp, Oryza sativa
tgacgtcccatccatccctccccccccttttccctcctcctccacctccactgccatggccgcctccgccgctcctctctcccgcgtggtagccgccgccggttgccgccgctaggggagcgcgacgggggaacggtaggggcgacccagctcgctctgtcgccccgcggctggtgggggtgcgcgcgggggagagcggttggttagtatggtgctggatctcaatgtggagtcgccgggtgggtcggcggcgacgtcgagctcgtccacgccgccgccgccgcccgacggtggcggcggggggtacttccggttcgacctggctcggcgggagccccgacgaggacgggtgctcctcgcctgtcatgacgcgccagctcttcccttcgccgtctgcggtggtggcgctggcgggggacgggtcgtcgacgccaccgctgacgatgccgatgccggcggcggctggggaggggccgtggccgcgccgcgcggcggatctcggggtggcgcagagccagaggtcccccgccggcgggaagaagagccgccgcggcccgaggtctcggagctcccagtacaggggcgtcaccttctacaggaggaccgggcgatgggagtcgcacatctgggactgcgggaagcaggtgtacctgggtggtttcgatacagctcatgccgcagcgagggcctatgatcgcgcggcgatcaagttcagaggcctcgacgcggatatcaactttaatctgaatgactatgaggacgacttgaagcagatgcgcaattggaccaaggaggagtttgtgcacatacttcggcgccaaagcacaggatttgcaagggggagctcaaagtaccggggtgtgacactgcacaagtgtggccggtgggaagctcggatgggccagctgctcggcaagaagtacatctatctaggattgtttgacagtgaaattgaggctgcaagagcatatgaccgggcagctatccgcttcaatggaagggaagctgttactaattttgatcctagttcttatgatggagatgttctacctgaaaccgacaatgaagtggttgatggagacatcattgacttaaatctgagaatttcacagcctaacgttcatgagctgaaaagtgatggtaccctaactgggttccagttgaattgtgattctcctgaagcttcaagttctgttgttactcagccaataagtcctcagtggcctgtgcttcctcagggcacatcgatgtcccagcatccacatttatatgcatctccttgtccgggcttctttgtgaacctcagggaagtacctatggagaaaagacctgagttgggtccccagtcgttccctacttcgtggtcatggcaaatgcagggctcccctttgccattactccctactgcagcatcatcaggattctctacgggcaccgtcgccgacgccgcccgctcgccttcctcccgcccccatccatttcccggccaccaccagttctacttccccccgaccgcctgactgccacctattctggtggaggcgacacctcaccgtgcatccaccgccgcttgctgataacattcgtcgtttgtccagagagggaccttctccatatgatatccctctctatgttccacctggttatgatcagaattctcacgctcatgattcttttatcttcatttttgagtgcgaaaccacgaatcgtgaccgtgctaccaggtaaacacccttgtacctctttgactctacaataaaattaatgtaagatattctggctaaaagtgattggccctccctactgtatttttacagagttgtaatttgaacagtgggcactaaagctggggcccactcgcaccagtgtctagtggagcgaagctttgcccttttcttgctatccagcaactattcctccgcctgcctccattgctgacagtggagatagcttcccagtggtcactgttccactgtactctgtcatagtttctgatcacccctattgtgccttgtctctttcacctcctccctcacttgtgctgcctctggccactagagtggcgccctgcactgttgccatgcatggctgccacttcgagagtggagatgggggttggcctttgggtgatttctgtgtcccatcttttggctcaatgtcgttttgggactggtgcatgtactggcaataggtgagatgagatatgaaatgtcctctgctgctttttctaaaaac

SEQ ID NO: 726 - DNA, 1260 bp, Oryza sativa
atggcgaccaccacctggtgctgtggttgctgctgctcctgcctcgccaccgctcgaagccgctcctcggtgctaaactccggggacgccggaggcggcggtggcggtggcggtggcggaggattattccggttcgacctcctcgcgagcagccccgacgacgacgagtgctccggggagcagcatcagttgccggccgcctcggggatcgtgacgcgtcagctcctcccgcctccgcctcccgcggcgccgtcgccggcgccggcgtggcagccgccgcgccgcgcggcggaggatgccgccctcgcgcagcggccggtggtcgcgaagaagacgcggcgcgggccgaggtcgcggagctcgcagtacaggggcgtcaccttctacaggaggaccggccgctgggagtcgcacatatgggcttacgatcgcgctgcgatcaagttccggggactggaggctgacatcaacttcaacctgagcgactacgaggacgatctgaagcagatgaggaactggaccaaggaggagttcgtgcacatactccggcgacagagcacgggattcgcgagggggagctccaagttccgcggcgtcacgctgcacaagtgcggccgctgggaggcacgcatgggccaacttcttggcaagaagtacatataccttgggctctttgacaccgaagttgaagctgcaagagcatatgacagggcagctattcgcttcaatgggagggaagctgttaccaacttcgagcctgcatcctacaatgtggatgctttaccagacgccggaaatgaggcaattgttgatggcgatcttgatttggatttgcggatttcgcaacctaatgcgcgtgactccaaaagcgatgtcgccacaactggcctccagttaacttgtgattcccctgaatcttcaaatattacagtccaccagccaatgggctcgtctccccaatggactgtgcatcaccaaagcacaccactgccccctcagcatcaacgtttgtacccatctcattgtcttggcttcctcccgaacctacaggagaggccaatggacagaaggcctgagctgggtcccatgccgttcccaacacaggcttggcaaatgcaggccccttctcacttgccattgctccacgctgcagcatcatcaggattctctgccggcgccggcgccggcgtcgccgccgccacccgccggcagccgccgttcccggcggatcaccccttctacttcccgccaaccgcctga

SEQ ID NO: 727 - DNA, 1290 bp, Oryza sativa
atggagctcgccggcagcaacaacaagcgggggagggtgagggggcccaacgacgacgacgacgacgccggggagccggacgccaagcgccatcaccaccagctgctgttgccgtggccgcagcagcagcagcagcagcatccggcgtcgcggatctaccgggtgtcgcgggcctccggcgggaaggaccgccacagcaaggtgtacacggccaagggcatccgcgaccgccgcgtccgcctctccgtctccaccgccatccagttctacgacctccaggatcgtctcgggtatgaccagccgagcaaggccatcgagtggctcattaaggccgccgccgccgccatcgacaagctcccttcgcttgataccgcttccttccccaccaaccccgcctcctccgccgtgcagcagcagctcaccaagtccggatgcagtagcacgtcggagaccagcaagggctccgtcctctccctctcccgctccgagagccgcgtcaaggccagggagcgcgccagggagcggagcagcgcggccgccgccgcggcatccaaggacgccggggacgacgccgccacccccaccgcgcccaccgccgcgcccgcctcctcgcaggcggcttccttcaccgagctactcaccgggatggccgcagccaacgcctcacccgctgaccacaagcagcagcaggcgtggcagccgatgaccgtcgccgcggccaccgccgactacatcggcttcgccgccgccgccgcgccgcatacgcagccgcggaaatccgccgcgggccatcactccgcgatgccgcacaccttcgcatcacccgctccccacctcgccaacatcacccccatcgccatggcgcccgcgcagcacttcaccctcacacccgccgccgccgagcaccacgcggagatgacgcactactcgttcgaccacttcatgcccgtccacgcggcagcagcggcggcggcggcggcctccaccccggccggcggcgactacaacctcaacttctccatgtcctcgggtcttgtgggtgtccacagtagggggacccttcagtccaattcgcagtctcacctctccagccatcaccaccaccatcaccagcaacagcagcagcagcagcagctgcagaggctgtctgctccgctggatgcgcccaacattccgttcctcttcagcccggccgccgcgcccaccgccgcggacacccagttcgccgccgcattgcagctctgggacgggttccggcacgccgacatcaaggagaagggcaagcactga

SEQ ID NO: 728 - DNA, 2074 bp, Oryza sativa
cccgggctgcaggaattcggcacgaggaaaagagaggccggccgggcggctgcactgggcgccgctatagctattaagctgctgcgactgtgtgtgtgcgtgcttgctctgcccatggagctgtggggttcccatggccactgtatcttttttccctctcatcaggatggcgagctgagctgagctgagctgagcttggcaaaccccatgcaggaatagaatttagcttcttgttttaattttcgctcttctcctttccggttaactgtgggtgagagggagctcaagctggaggaagacaagaaccagttgtccaagggcttagacccttggacgagcaaccctaccgccagcgcgagcaccttgcactacctgctccaggagaaggagagggcgcagcaagcgcatgagcagcttcagatctaccagcagcagcagggattcggcagcttcctgcaacaccggatcaggcagccggcgagccgggggccgggaggtggaggcggcggcggcgatggcggcggcagcagcggcgagtcgacgcccgtcgaagcgctggccactgcattcggggcaggccgcatcgtgcggtccgcggccgggcgcaaggaccggcacagcaaggtgtgcacggcgcgcgggctgcgggaccggcgcgtccgcctcgccgcgcacaccgccatccggttctacgacgtgcaggaccgcctcggctacgaccggcccagcaaggccgtcgactggctcatgcgcaacgccaaggccgccatcgacgagctccccgaccgcgccgaggccccgccgccgcccgccgcggcgtcgacggagcagcccgaggccaccgagcaggcgacctcgacgtcctacgggttcggcaacactaccggcggcaccatgaccagcgccgcgtcggccgctgctggctccttccttccacattcgctgggggcagatcgagtctccgacagcgtcaagtccctgttcccctcctcgtccacagccagcggcgccgcctccgccggacacgacgagtacaggggatccccgccggacctcctgtcgcgcacgacaagcaaccagcagccgcaggagctgtgcctcaccctacagtcgaaccagcaccagatcttcagccatgtctcgtcgaaccaccacggtatgatctcgagtgcaggcgttccaggttggcccgaccacagccagagaatgcaggcatggcatgccccggagaacagcacaggagacggccgcggcggcggcaatggcgacggctacatgttcgccatgccgtcgcggcaagggctggaccagagccagctcttctcgcatggggaaccccttcagtccagcggtcgcgggtgggcgtcagcccgcgcatggctagaccccctcgcagtcgcagccatccaccaccagccgtcgacaatggctgccggacaggtcggcttcggccatctcgttggcggcgccggtggcggcggcgggtttatggggtttctcgcgccggcggcgcagcggcttgagggcgaggaggagcacggaagtgaggtgatcaggtgatgagaagagactgaagaattgatgcatggcgcgcatgcaggaggtgtgtgctttctattaattaacacacttcactgatctgcttaagggtacgtgtatgtcatttcatgtaggattttggctgatgaaatttccctcattattatctgctgtcttcatgcatgtgtaaccaaggcttaattaattattaagagtacgttcccttggaactaggcagctgttgctgttgcattagttgctattgctgttttcccctttattctcggcatggacaagatgtgatgatgaagagatgatatggtctatgatcttgatggcttttcccccctttggatcttgtaatgtttcttatatctgattattctgaagaagattccggcctttagccaattcgaaggttgtcctagatcctgattccataaaggcgccaatttttttttgcaataatatatcggcaatatgggaggtacaggaggatgaaagcagtaaaagggattcagattaagaaaaaaaa

SEQ ID NO: 729 - DNA, 1896 bp, Oryza sativa
atgcgcttaattccttatccatggagactaggttatgggatccggcgaggtggatggacgcgcattggagcagcaacagtagcggcggggaagaaggcggcgggggatctggatccgaggcaccaccaccaccgggtcacccacggcggcgacggcggcggcgtaggaggaggaggaagcgggggacaggaggaggcagatgagcagcagcagcagcagcacgaccaccaccggcttctccagctccaccaccaccagggtgtgcagcaggaccaagaaccgccgcctgttcccgtcttccacctccagccggcgtccgtgaggcagctgtcgggctcctccgccgagtatgcccttctctcgcccatgggcgacgccggcggccactcccaccaccaccaacacggcttccagcctcagctcctctccttcggtggcgtcggccaccaccaccacctgcatcagttcacggcgcagccacagccccccgccgcgtcccacactcggggtcgtggaggtggaggtgagattgtccccgcgacgacaactccacggtcgaggggcggaggcggcggcggcggcggggagatcgtggcggtgcagggcgggcacattgtgcggtcgacagggcggaaggaccggcacagcaaggtctgcacggcgcgcgggccgcgcgaccgccgcgtgcggctgtcggcgcacaccgccatccagttctacgacgtgcaggaccggctgggctacgaccgcccgagcaaggcggtggactggctcatcaagaacgccaaggacgccatcgacaagctcgacgtgctgccggcgtggcagcccactgccggcggcgcaggcgcgggcaatgccgccgcgccgccgtcctcctcgacccaccccgactccgccgagaactccgacgaccaggcgcaggccatcaccgtcgcgcacaccgccttcgacttcgccggcgggggcagcggcgggaccagcttcctcccgccgtcgctcgactcggacgccatagccgacacgatcaagtccttcttccccatgggtggcaccgcaggcggggaggcatcgtcgtccaccacggcggcgcagtcgtcggccatgggtttccagagctacacgcctgacctcctgtcccgcaccggcagccagagccaggagctccggctgtcgctgcagtccttaccagaccccatgttccaccaccagcaacatcgccatggcggcggcggcggcggcggcaatggcaccacgcagcaggcgctcttctccggcgccgccaattactcgttcggcggcggagccatgtgggccaccgagcagcaggcgcagaaccagcgcatgctgccgtggaacgtgcccgaccccggcggcggcggcggcgccgcctacctgttcaacgtgtcgcagcaagcggcgcatatgcaggcggcggctgcggcgctgggtggccaccagagccagttcttcttccagaggggaccccttcagtccagtaaccagccctccgagcgaggatggccggagaccgtcgaagccgacaaccagatgagccaccaccaaggagggctgagcccctccgtgtcggcggccatcggttttgccgctcccggcatcggcttctccggcttccgcctccccgcgaggatacagggcgacgaggagcacaacggcggcggcggcggcaatggcgacaagccgccgccgccgtcgaattgtcgattgcattcgggaggagcaaagtttggaggtagcacaagtgcactactactgatgctactacatatcggttggttggttggttggttttccatcgatctcttctgctgctgcgcatgtcattggtttttgtttcaagaattcactcggagcttcttagaattaggcttgtga

SEQ ID NO: 730 - DNA, 2351 bp, Oryza sativa
gaggagaagaggaggcttcaccttcccaaccaaacccaacctcgagcacaagcggagcagatgccgccgccgccgccgccgcgcgcgccgcgccgcgccgccgggtagctcagcgcaaaaaagccacagccgcccgcccgcccgatccgttgcagcatggggcgcggcggctcgcgcgcggcgtgcgccgccgcggcgccgccgtggcactcgctcccggacgaggtctgggagcacgccttctccttcctccccgccgccgcggacaggggcgccgcggcgggggcgtgcagctcgtggctccgcgccgagcgccggtcgcgccgccgcctcgccgtcgccaactgctacgccgccgcgccgcgggacgccgtcgagcggttcccgtccgtgcgcgccgccgaggtcaagggcaagccccacttcgccgacttcggcctcgtcccccccgcctggggcgccgccgcggcgccgtggatcgccgccgccgccgacgggtggccgctgctcgaggagctcagcttcaagcgcatggtcgtcaccgacgagtgcctcgagatgatcgccgcgtccttcaggaacttccaggtgctccgcctcgtctcctgcgacggcttcagcaccgcgggcctcgccgccattgctgccggttgcagagtaggcagacacctaagagaacttgacctgcaagagaacgagattgaggattgttctattcattggctcagcctcttcccggaatcgttcacttctctagtaactctaaacttttcatgcttagagggggaggtcaatatcactgtacttgaacggttagtgaccagatgtcacaacctgaagactcttaagctcaacaatgctatcccccttgacaagcttgctagcctccttcataaggctcctcagctagttgaactcggaactggcaaattctctgctgattaccattccgatctgtttgcaaagctggaggcggcgtttggaggttgtaaaagcttgagaaggctttctggggcttgggatgctgttccagattatctgccagcattctattgtgtatgtgaaggcctcacatcacttaatctgagttatgctactgtgcgaggtcctgagctcatcaaattcattagtagatgcagaaatttgcaacaattatgggtgatggacctcattgaggatcatggtttagctgttgtggcatcatcttgcaataaacttcaagagttgcgggtcttcccttctgacccttttggtgcaggattcttgactgaaagaggtcttgttgatgtctctgcaagttgtccaatgttggagtcagtgctctacttctgcagacggatgacaaatgaggcacttattaccattgcaaagaaccgtcccaacttcacttgcttccgcctatgcatccttgagccacacactccagactacatcacacgggagcctcttgatgcaggtttcagcgccattgtggagtcatgcaggggccttaggcgtctctctatctcaggccttctcacagatcttgtgtttaaatccattggggcacatgctgatcgtcttgagatgctttcaatcgccttcgctgggaacagcgacttgggcctgcattacatcctctcaggctgcaagagcctgaagaaactggagatcagggactgcccatttggtgataagccattgctggcgaacgcagcaaagctggagacaatgcgatccctttggatgtcgtcgtgcttgttgaccctgggcgcatgccgacagcttgcacgcaagatgccccgccttagtgtggagatcatgaacgatcctggaaggtcatgccccttggattcgcttccggatgaaacacctgttgagaaactgtacgtctaccggacgatcgcaggtccaaggtccgacacaccagcctgcgtccagattgtgtagggggcagtatgtgcggtatcggtatgcgggtgttatggaggtatttattttcaatctcgattagtaccttcaaacaccttcctcgcataacatagaattgtttccttccaagtagaaaggctgatggttggatagacttgtcatgatctctactcggctacaaaactgttgcaggtgtagaatgaaaattcacagcctttttcaggtgttaataactgtaggaggagactggatgaattacagaaaactactagatagcatcatgagaaaacttcggtttgttttcttagcgtgtttagcactttgtatgtataaaaatatggcatccatttgtactgtactagtggaaaatttgtatctggagctgagctttgtcacttctacttttttgacctaaattatgaattgttgttgcttcagca

SEQ ID NO: 731 - DNA, 2427 bp, Oryza sativa
  misc_feature (2372)..(2372): n is a, c, g, or t
gatgttcaccccgcccccatgccccgcaatcccatccaggttcatccgcctcccgtcttctttttttttaattcatccgcaagcactgcgaacttgcgaagggcgcgggtacaagaaaagaagagaaaaataaaaaggagccggattataagtaggtagtggtggtggtggaggaggaggagagcaaatcgaggtagccatggcgatgcaggccgccttcgccgcctcgatgttcccgcagctggcgcagcggaggggaagcgatcgcgcggtggtggtggcgccgccggcgccggcgccggtgagggtggcgatgaggagcggtggggcggcggcggcggcggcgagaggggtgaggtgcagggcgagcctgatcgagcccgacggggggaggctggtggagctggtggtgccggaggagggagggcggcgggaggcggcgcggcgggaggcggcggcgctggcgcaccgggtgaggctggggcgggtggagacggagtggctgcacgtgctgagcgaagggtgggcgagcccgctgcgagggttcatgcgcgaggccgagttcctccaagcacttcatttcaacgccatccgcggcggagacggggccatggtcaacatgtccgtgcccatcgtcctccccctcggtgacgcccagcgccgcgccatcgaggcgtccggcgcccgccgcgtcgcgctcgtcgacgccgccgaccgccccctcgccgtcctcagcgacattgagatctacaagcataacaaagaagaaaggattgcacggacatggggaacaactgcacctgggctgccttatgttgatgaggcgattacaaatgctggtgattggttaattggtggtgacttggaggttatagaaccaatcaagtacaatgatggtcttgatcagtatcgcttgtctccagcccagctgcgtgaagagtttgccagacgcaatgctgatgcggtattcgcgtttcagcttcgcaatcctgtacacaatggacatgctttgctcatgactgatacacgcaaacgccttcttgagatgggttacaaaaatcctgttcttctgcttcatccattgggaggattcacaaaagcagatgatgtgcctcttagttggagaatgaagcagcatgaaaaggttcttgaggaaggtgtcctcaacccagaatcaactgtcgttgcaatcttcccctctccaatgcattatgcagggccaactgaagtgcaatggcatgctaaggctcgtataaatgctggtgcaaacttctacatagttggaagagatcctgctggtatgggccacccaactgaaaagagggacctgtatgatgctgatcatgggaaaaaggtgttgagcatggctcctgggcttgagaagctcaatatccttcctttcaaggtggctgcatatgacacaaagcaaaagaaaatggactttttcgatccatcaaggaaagatgatttcctgttcatctctggcacaaagatgcgtactcttgccaagaaccgccagagcccccctgacggattcatgtgcccgggtggctggaaggtccttgttgaatactacgacagcttgacgccatcagcggacagcagcaaactgcgcgaggcggttgcggcctagaaagctgaaactacctcaaataagcaagaacattgcatcttgcaactgtaaaatggttctttcagagagagaaccaatggtatatgtgtatactactggtcgcaaggcctaaacatttgggtttgattggaagcgcattctggtgtgatttgtatggtgccctatcatctggtaatgctacattggaagctcatcatgttgttggtgttaataaggatgagcctttgtgtgctctgctagatatgtacatatacaatgtggtggtatttatatagtgcttggtgtgtttgctattatagaaaaaaaaaaaaaatcttcaaaaaatcgagcgcaaccccccccttttcccccccctggggggtaaaaataccaaaaaaaaggccccccacccccgaattgccccccttcccccccaacaacgttttggccccaccccccccggaaaaggggggaaaaaaagggggggaacaaccgcgcccccccccgtggagaaaaggcggggcgcccccgccacattttaaaataaacccccgcgcgggcggggaggggggggggtgtgggggggtggtgccaacagatcacgatgatcgcacaacagtctcactgccaggccattagcagtgttcaggctattgtgcagcagctacggctacaacagtttgctagcgtctacttcgatcagagtcaagctcaagcccaagctatgttggccctaaacatgccgtcaatatgcgggaantacccaaacttcaacacctgttcctgtagcattcccaccgtcggtggtatctggt

SEQ ID NO: 732 - DNA, 3128 bp, Oryza sativa
ccacgcgtccgcaccagaataatttttatgcattcatacaagttgcttttctagaagcaaaggtgaaaggtccaagtttcagtgagatgagaatggaccagttaagttactctaagcaaacatgatgtgccctttattcacaacatttaacaattgttacttgagcagttttgcccttagcctaaataccaaatcatgaataaacattcataaaaaggaatttgggcccgcttattgttctgcaaatgcactgctagaggtttatagcatggatatctatccaaagtcttgagtgtaaagttcatataacaaaccccaagtaattaactgcaggactactggaaagtacaagaggagaacaaaccagggattggatcattcgtttctgtcagaaaaaaaaaaactttgcaaagcagtcacgatcattaggctagtagaagcacacttgcatagccaaagaaaactcatcattatcaattcaattatcggaatgaaaggagcttcatttttgcaaactgaatatgaccttagaacagcaggcacatgccctttaggatgtgttgccttcactcttcaataggtggcagcataaaccatagcactataaatggcaccttgtatggccaccttagaggaatcaaattcacctgaagcacctaaggttcacatggacttgccatcctcacagctcaccaatcttggaggcaccgatacattgtgatggaatttcagccatttcctcagggagttcacccaaacacttcagaaccagccatggagcccatggcaagtgagtcatctgtgcccatagggacagcttttgcagacttgctgctgcaagggccagagcacccaagcctgtggaatgatctcaccggcatgttcaggaaggcattccgttggcaaggtgcagacaagcgcttcacactgtctgtgtatgtgatgtctgttctacagggtctgtttccaatacttgactggtggaaaacctacaatctgaaattctttcgaagtgacctcatggctggcctaactcttgcaagccttagcattccacagagcattggatatgcaactctggcaaaactggatcctcagtatggtctttatacaagtgttgtgccacctcttgtatatgctgtgacggggtcctctagggagatagccattggaccagttgccattgtgtcattattgctttcatcaatgattcagaagatagttgacccatctgttgatccagcgttctaccgaaaaatggtctttaccgtgacattccttactggtgtctttcagtttgcatttggtctgttcagactgggatttcttgtggattttctatcacatgctgctatcgtcgggttcatgggaggagctgctattgtgattggattacagcagctgaaggggctgcttggacttagtcattttacaaatagaactgatgtcgtctctgtcaccaaggcagtctgggtttcagttcacgaaacatggcatccggagaacgtcttcattggatgttcctttttcatgttcattcttgccatgagattcattggaaggaagtacaagaaactcttttgggtctctgccattgcacctgtactatcagttgcactatctactctgtttgtctatgcgacaagagcggataagcacggcgtgaagattatacaaaaagtgaattcaggtattaatgcaagttctgtcgagcagatagatctcaaaggaggctatgctgccgaatgtgcaaagattgctcttgtttgtgctgtgattgctctgacggaagctgttgctgttggccgctctttttcagcgatcaatggatatcggttggacggaaataaggaaatggtagcaatgggcttcatgaatatagcaggatccttatcatcatgctatgtagcaacaggttcattctcgcgcacagctgtgaacttcgctgctgggttgcaaagacaaccgtttcaaacattatcatggctgccactgtgatggttgccttggagcttctcacaaagctcctgtactacacacctgtgtccatccttgcatcaatcattctgtcagctcttccaggattgatcaatgtgcaggaagtccgcttcctgtggaaagtcgacaagatggacttcctcacatgcatgggatcattccttggtgttctattcggatcagtggagattggtctttcagttgcacttcttgtttcctttgcaaagatcattatacagtcgatttggcctcaagtagagattcttgggaggcttcagggcacagaaatcttctgtaacgtcaagcagtatccagtggttcacgaaacaccgactgtactgaccgtacgcattgaaacatcattcctttgcttcgtcaactccagttccatcaaagaaaagatcatgggatgggtaaccgatgagcgcgaggcattttgctcggtcgttcttgacatgtcaaatgtggtaaacatggatacttcaggtcttgtggcgctggaagaactgcacaaggagctggcgtgtctcggcatccagatggctatagccaagcctggatggcaggtgatccacaagatgaaactggcacggctcgtcgacggaatcggagaaggatggttcttcctcacggtgggcgaagccgtggaagcttgcctggcaaacaaggcgggaaacgccctggaatgctgctgaatcgaatccaccgtgtgcatggtctctccggtggttgaataaagagagacactagtgcttcgtggtacgctacaaaaggattgtgttgtgtgctagtgctgcacgatgatgcagcttcagctgtagtgtggtgcttcatggattgtgcgacgtgcaactgttgggggaagacgaactgtgtctgtctgaacttagtatgccgagttcgtctaaattccccactatagctgtaggtttgtgatgtatcggatgcatttgtgaagagcaaatgccaggttttaagtgttggaactgatgattgtgtaatattattatattaatcgagtttgtataattaatttgtactcgagtttgtgcgttttggcaaaatccgagctactatgctgcaaaattcatttgtcccaaaaaaaaaaaaaaaaaaaaaaaaaaaacacc

SEQ ID NO: 733 - DNA, 1188 bp, Oryza sativa
atgatgatgatgagcggtcgcccgagcggcggcgccggcggaggtcggtacccgttcacggcgtcgcagtggcaggagctggagcaccaggcgctcatctacaagtacatggcgtccgggactcccatcccctccgacctcatcctccccctccgccgcagcttcctcctcgactccgccctcgccacctccccttccctcgccttccctccccaaccttcactggggtggggttgctttggcatggggtttgggcggaaggcggaggacccggagccagggcgatgccggcgtacggacggcaagaagtggcggtgctccaaggaggcgtacccggactccaagtactgcgagaagcacatgcaccgtggcaagaaccgttcaagaaagcctgtggaaatgtccttggccacgccgccgccgccgtcctcctccgccacctccgccgcgtcgaactcctccgccggcgtcgcccccaccaccaccaccacctcctccccggcgccctcctacagccgcccggcgccgcacgacgcggcgccgtaccaggcgctctacggcgggccctacgccgcggccaccgcgcgcacccccgccgccgcggcgtaccacgcgcaggtgagcccgttccacctccacatcgacaccacccacccgcacccgccgccgtcctactactccatggaccacaaggagtacgcgtacgggcacgccaccaaggaggtgcacggcgagcacgccttcttctccgatggcaccgagagggagcaccaccacgccgccgccgggcacggccagtggcagttcaagcagctcggcatggagcccaagcagagcaccacgcctctcttcccgggcgccggctacggccacaccgcggcgtcgccgtacgccattgatctttcaaaagaggacgacgatgagaaagagaggcggcaacagcagcagcagcagcagcagcactgcttcctcctgggcgccgacctccgtctggagaagccggcgggccacgaccacgcggcggcggcgcagaaacctctccgccacttcttcgacgagtggccgcatgagaagaacagcaagggctcctggatggggctcgaaggcgagacgcagctgtccatgtccatccccatggccgccaacgacctcccgatcaccaccacctcccgctaccacaatgatgaa

SEQ ID NO: 734 - DNA, 2526 bp, Oryza sativa
ggttggctagtccaggactagagggtgcagtgcattcaattgcttgcttcctcttcctccccccctccttccccaaagcagcaaggccagcctgtgtttcccaaacacccacagccatcacctcctcttcttcctctctgcagtaggggtgctaggctagggtagctagctagctaccatcatcatgagctcaatgccacaagaagccattgctccccatccttcctaaccttcctgctggttttgcaaacatcccacacacacacaaagcagtgacagtgagtgccaatgctgagctcttgtggtggccatggccatggaaatccaagaagcttgcaagaagaacaccatggcagatgtggtgagcagcaaggtggaggaggaggaggagggcaagagcaagagcaagatgggttcttggtgagagaggcaagggcatccccaccatctccatcttcttcatcatttcttggatccacaagctcttcttgttctggaggaggaggaggagggcagatgttgagcttctcctcccccaatggaacagcagggttgggcttgagctcaggaggaagcatgcagggggtcttggcaagggtcagggggccgttcaccccaacacagtggatggagctggagcaccaggcactgatctacaagcacattgcttgcaaatgtttctgtcccttccagcttgctcctccccatcaggagaagcctccatccatggggtactaccttttttattcagctcatgtgattgttattctgttctgcgtcatatcccctttctgttgtaaatagctcaagataggaataaaggaataagtacttagaaaatatgaaagaagaaaatgcaggtcatatggttgcagttgcctgttagtttcagatgtataaaggtgtcccagattggggttctgttgtgttgaggttggtagttatatcttgttgtctttcttgggacaggatggctttgtgattaattagtttgtaaaggcagtaatcgaagtccctttctggtactaaaagcagtattggctgcaaatctaggcattataatgatttgaagattgcattgatactagaaatgtactgcttttggatgtttgcatgatgctcatgtgctaatatttccagttaccaatgtggtgcttcttgagtttagatataaaactcttctcttacattgggattctgatttttttttagttgtgcctctagtcttttccacaacaagatctccaaatgtagtcataaagtgttctgattccctttaactggcgtcatgtttggtatgtacaaactaagttcttatgcagacctgggaggaatgttgctgaaatagtgcaagaatatatcgttttgaggtggtttatatatttctgacatgaaatgggcattctattttgcaccaggatggggatcattccctcctggctgtgctgatgtagaacccagaagatgccgccgcacagacggcaagaagtggcggtgctccagagatgctgttggggatcagaagtattgtgagcgacacataaaccgtggtcgccatcgttcaagaaagcatgtggaaggccgaaaggcgacactcaccattgcagaaccatccacggttattgctgctggtgtatcatctcgcggccacactgtggctcggcagaagcaggtgaaaggctcagctgctactgtctctgatcctttctcgagacaatccaacaggaaatttctggagaaacagaacgttgtcgaccaattgtctcccatggattcatttgatttctcatccacacaatcttctccaaactatgacaatgtagcattgtcaccactgaagttgcaccatgatcatgatgaatcttacatcgggcatggagcaggcagttcatcagaaaaaggcagtatgatgtacgaaagtcggttaacagtctctaaggaaacacttgatgatggacctttaggtgaagttttcaaaagaaagaattgccaatcagcttctacagaaatcttaactgaaaaatggactgagaaccccaacttacattgcccatctggaatcctacaaatggctactaagttcaattcaatttccagcggcaacacagtaaatagtggtggcaccgcagtggagaatcttatcactgataatggatatcttactgcaagaatgatgaatcctcatattgtcccaacacttctctaaggctgtgtttgaaagttcatgttggattcgcaaatgattgaaagtacgtttatggatggttctataagttcctgttgtttccttcgttatgtgttcttgtgttcctcacctttttatcttttggttgaggttggtatgttgtaattttctcctgtgctaccttgtaatatgctgaagttaaatgctcttctaaaaatttctgttgcaatccaagattcaggatttatgtgtccaattctgaattttaatgaatcatgccccttaaatgtaaagggaattgtatatttcattaatttgacaaaaacgttgccttctgctcc

SEQ ID NO: 735 - DNA, 1056 bp, Oryza sativa
gacaactcactgccccccgtcttctttcttcattcctcttcccaccaagaaccccaaaccttacctccattgagttcgaaaccgaggagcgaggagttacaagccgagttgtcagaatgggtgaggagaaggaagccgactcgccgcagccaccgtccaagctgcctcgcctctccggcgctgacccgaatgccggagtggtgaccatggcagcacccccgccgccggtgggtcttgggctggggcttggactcggcggcgacagccgcggcgagcgtgacgtggaagcgtcggcggcggcggcgcacaaggcgacggcgctgacgttcatgcagcagcaggagctggagcaccaggtgctcatctaccgctacttcgccgcgggcgcgcccgtgccggtgcacctcgtgctccccatctggaagagcgtcgcgtcctcctccttcggcccgcaccgcttcccttccctggcagtgatggggttggggaacctgtgcttcgactaccggagcagcatggagccggacccagggcggtgcaggcgcacggacggcaagaagtggcggtgctcgcgcgacgtggtgccggggcacaagtactgcgagcggcacgtccaccgcggacgcggccgttcaagaaagcctgtggaagcctccgcggccgccaccccggcgaacaacggcggcggcggtggcatcgtcttctcccccaccagcgtcctcctcgcccacggcaccgcgcgcgccacctgaccagtgaccagaccggcgcctgtttgtttgtttgtctcggcgcatgggaaaacccaaatccgcagggattatgtcatgtcctgtaactctttttttcctcgcaacttttgaagccaaaacaattctacccgtgttcgatggctgtcgacgctcggccgacggatctagatcgacagttattctggcggaacaggccatggcatccccatagggcattaaccggcgggttacagcgcgggaacgcgctccatagcgtgaaccccccaggaacaacgcgaacccaaagaaagagaccaaacatata

SEQ ID NO: 736 - DNA, 1915 bp, Oryza sativa
ttacaaaaccccagccaccgagagctctcccgctccactcgccgcacaccaccaccctcacccctccccccatccgcgtgatctcccgagcagctagagcgcgcgcccgcggcgcctgtactgcgagaccgcttcgctcgcttccggtcggtgaagaggcggtcggtcgcagctgaagtagttgttgcagagatgatgatgatgagcggtcgcccgagcggcggcgccggcggaggtcggtacccgttcacggcgtcgcagtggcaggagctggagcaccaggcgctcatctacaagtacatggcgtccgggactcccatcccctccgacctcatcctccccctccgccgcagcttcctcctcgactccgccctcgccacctccccttccctcgccttccctccccaaccttcactggggtggggttgctttggcatggggtttgggcggaaggcggaggacccggagccagggcgatgccggcgtacggacggcaagaagtggcggtgctccaaggaggcgtacccggactccaagtactgcgagaagcacatgcaccgtggcaagaaccgttcaagaaagcctgtggaaatgtccttggccacgccgccgccgccgtcctcctccgccacctccgccgcgtcgaactcctccgccggcgtcgcccccaccaccaccaccacctcctccccggcgccctcctacagccgcccggcgccgcacgacgcggcgccgtaccaggcgctctacggcgggccctacgccgcggccaccgcgcgcacccccgccgccgcggcgtaccacgcgcaggtgagcccgttccacctccagctcgacaccacccacccgcacccgccgccgtcctactactccatggaccacaaggagtacgcgtacgggcacgccaccaaggaggtgcacggcgagcacgccttcttctccgatggcaccgagagggagcaccaccacgccgccgccgggcacggccagtggcagttcaagcagctcggcatggagcccaagcagagcaccacgcctctcttcccgggcgccggctacggccacaccgcggcgtcgccgtacgccattgatctttcaaaagaggacgacgatgagaaagagaggcggcaacagcagcagcagcagcagcagcagcactgcttcctcctgggcgccgacctccgtctggagaagccggcgggccacgaccacgcggcggcggcgcagaaacctctccgccacttcttcgacgagtggccgcatgagaagaacagcaagggctcctggatggggctcgaaggcgagacgcagctgtccatgtccatccccatggccgccaacgacctcccgatcaccaccacctcccgctaccacaatgatgattaatctcttgaagaagccaagaagtgatcaacacgcggaagaaatcaacagcttctttcacggcgtgcgagctgcatgctgatgctccaggatcgatcgatcgatcattgcatctccaaactaatcacgcttcgatctttcaggacttcatcaatgacaggccgaaacctcctacgagttctctgatgatattcttatttttttcccacttcttttcgttgagctttttgtaatgttgcttcgagtgttactcctacattttctccgaaatggcctcagaatgatgcggtcgggctgattaattaggttagactcttcctgaaccaactaggaatagattttctgcctggttcctgtcagtccttgtaatatctgcagcagcttgtgagacaagcgtgttcgcttttgtgaacgccctttttcttctttccgattcctctgcctgtgatagtactcgctccgcgaaaaaaaaaaaaaaaaaaaaaaaaaaaaaaaaaaaaaaaaaaaaaaaaaaaaaaaaaaaaaaaaaaaa

SEQ ID NO: 737 - DNA, 893 bp, Oryza sativa
ggagggattttgattagtaggttttgtggccatggaaatccaagaagcttgcaagaagaacaccatggcagatgtggtgagcagcaaggtggaggaggaggaggagggcaagagcaagagcaagatgggttcttggtgagagaggcaagggcatccccaccatctccatcttcttcatcatttcttggatccacaagctcttcttgttctggaggaggaggaggagggcagatgttgagcttctcctcccccaatggaacagcagcatctttggcatcaggcctatttgctcttcttggctttagtagtgagtacttcatcatttgtgctcatcagttttgcttgtgttgtgatgaagggttgggcttgagctcaggaggaagcatgcagggggtcttggcaagggtcagggggccgttcaccccaacacagtggatggagctggagcaccaggcactgatctacaagcacattgctgcaaatgtttctgtcccttccagcttgctcctccccatcaggagaagcctccatccatggggtactaccttttttattcagctcacaccaggatggggatcattccctcctggctgtgctgatgtagaacccagaagatgccgccgcacagacggcaagaagtggcggtgctccagagatgctgttggggatcagaagtattgtgagcgacacataaaccgtggtcgccatcgttcaagaaagcatgtggaaggccgaaaggcgacactcaccattgcagaaccatccacggttattgctgctggtgtatcatctcgcggccacactgtggctcggcagaagcaggtgaaaggctcagctgcttagtggtcacacagtgtgaggccaccagtggtttatatcatgcctgaacaacc

SEQ ID NO: 738 - DNA, 1559 bp, Oryza sativa
aagctgaaagattttacttgcgtcagctccggctaccgtggtcaatgtgcacaatatttcatttggtcctcacctcagccctgtaggcatgcaggcagcaggccttcagttactgcatcccttcggaatcgttaaatgaacagtattcaagcagccgcaggagtatgtgtccggtgtcccactgacaccgataagcagcgacaacgtcgacactcaacatatcccatcccttccttatcccaacgacctgcacgctgcattttcatcactagcatcagtgtattcaaacctgcagcttacactgaagagtgaagactgaactccacagatatgttggccgagggaaggcaagtctacttgccgccgccgccgccgtccaagcttcctcgtctctccggcaccgatccaaccgacggcgtggtgacgatggcagcgccgtcgccgctggttcttgggctgggtctcggtctgggcggcagcggcagcgacagcagtgggagcgacgcggaagcgtctgcggccaccgtgcgggaggcgcggccgccgtcggcgctgacgttcatgcagcggcaggagctggagcagcaggtgctcatctaccgctacttcgccgccggcgcgcctgtgccggttcacctcgtgctgcccatatggaagagcatcgccgccgcctcctcgttcggcccgcaaagctttccctccctgacgggcctggggagcctgtgcttcgactacaggagcagcatggagccggagccggggcggtgccggcgcacggacggcaagaagtggcggtgctcgcgcgacgtggtgccggggcacaagtattgcgagcggcacgtccaccgtggccacggccgttcaagaaagcctatggaagcctctgcagcagtcgctcccacatatctcccggtccggccggcactccacaccgtcgccaccctcgccaccagcgcgccatcgctgtcgcacctcggtttctcctccgccagcaaagtgctcctcgcccacaccaccaccggcaccacgcgcgctacttgatctcattgttatctccgaggattatgccggtgcactgtctgtaacctttttctcgtaatcacgcctcggtttgttcccaatgcatcgtcacgcattgctagtttgacagtttgctaccgctgcctctgtgtgtgcctgtgcgtgtggcagccgaggtgtttttgtttggttgggtggtgggaggcgcgccccggtgcggtggtgggcgtggcccccggctacctagtgctggttcctgcgtgtgcctgtcgaacctgtggagcgtggtcggaagtacggtacgcactgtccggtctcatatgccggggcagaggggttcggtccagtgtggtgcaggcgtgcggattgggatcacatgcagtggctactgcaacttatgcagtcctaaagacaccattgaattataaattaacgtcctagatctttccttgatactgttcacaaataacagtgaaaagttccttcctgtagcaggtactatagcaattactgtttaaaataactgtagcatttgtttc

SEQ ID NO: 739 - DNA, 837 bp, Oryza sativa
atggccgccggcgcgccggtgccacccgacctcctcctccacctccgccaccgcgccgccgccgccgccgccgccgacgtcgacaccgtcccctccctcgccttccctccccatcacctggggtgggggtgctatggcgcggcggcggcgcagtacgggaggagggtggaggacccggagccggggcggtgccggcgtacggacggcaagaagtggcggtgctcgagggaggcgtacggcgagtccaagtactgcgagaagcacatgcaccgcggcaagaaccgttcaagaaagcctgtggaaatgccgccccccgccgccgccgccgtctaccgcccgtccgcgctctccatctcgccgccgccgcacgacgccgacgcgcccagctacggcgccggcgccggcgctcctctccagctccacctcgactccttccacgcctcgacgtcgccgccgccgtcctaccacaggtacgcgcacaccagcagcgcgccgctcttcccgtcgtccgccgccggctacggcggcggctggtcgttgtccaaggagcactgcctcaccctcggcggcgccgccgccgacctgagcctcgacaagccggcggatcaccaccacgacgccacgtcggcgacgacggagaagcccctgcggcgattcttcgacgagtggccgcgcagcgacgacgggaggacgccgtgggacggcacgcagctctccatctccatccccaccgccgccgccgcgtcccccgacctcgccatcgccggcgccgcctcgcgctaccacagcaacgctctagtctacatcaggttgatgctaacgccgtacttctgctag

SEQ ID NO: 740 - DNA, 3451 bp, Oryza sativa
gattaacaagcggcgagcgctcgagctgggtgcgcgagcggttggcggcgacggccggcggccggcggcgaggtcgagcgaggaggcgggccggcgaggcgcgcggtactttgtgcctcgaaacgagtgggcctttattttttttttggttctgtttcggctcgtcgcggatttcgcacggtttgcttcgttcttggtgattttcttgaagcgtcgtcttctccaatcgatcgcttcctgtagcttctccacccttcttctgtggtggatacagatttgttcttggaagcggctgggatttcggttaacgatgccattggtttctattctaacatatgctttctcttgtctcttgtgtctcttgtgtgttcagattgggcttgttggtgtcggatttgattgtggtttcgtggctgtgatgacaatcaaacctcgtttctcgatgctgagacttgatttgttcaaggaccagaactgtgctgaccttaatttgtgcgtgtctgagccaccccaaacacaccatgtccgaatcgatttctgcgaaagttagtatgtctgcacgatgccactcgatgctactactagtatttaggtgtctttattagctttttcctcttctatgtttattggctgtttcttgcatttgcgttgttgtagtgtggctgtgaggactaactactttgtttctcgatgctgacttgattcaatcaatcaaggaccaaaaaaatttgatgacctttgtgcgtgtctgagccactgcaactcagttttttcagtcttcgcttgtgtgaagatatcatcttgccttccgtgttttgagcctgaacgataaagaagagatgtttcttggtgctgattcgactcattttaggatggaattttgacgaggctcatgcgtgtctgaagtctgaaccattgtaaaacttggatgtagttgttgttttaggtgtctgaagtctgaaccattgtaaaacttggacgtagttgttgttttttttcctaaaaaaagagaacttttttctctcgttttttctctgctgtatttgaatttgttcattttttccagctgttgtacacttgtacttcatattgggatactgaatgttaggtgcgatcaatgtagtagtgcttgcatgtttgacaaactcatggacattaactcaagttatctaaaacattgagatccttggaatagttatgctggaactattgcatggaaattttacaactcgctatatgctagaagcgaatccccgtagttcattttcctcaatcagcccagtagatttctagctaatggtatctgataaggggcaaattgttttttcaaggatacagctgaattcataagaactgaaaatcgcaattagctggtattacattgcagaagcttgagaacagaaagaagggaataacatgcatgggtaacgccaatactaaagctatcccatggtgagctcattaacgacttgatctccatttcctgaagattcacattgcatgatcctcgaggttcagtaaccaaccatatggccttgcttctggtttcatgattgaatcgtcaggatttttggagtttgtcaagatctcacctagaggtccaccttgaggcatctcccaagaacttgagatgctatcctcttgcatttgtgccatattaggtgcatggcagctgacgcgtgggtcctctggcgaggaatagaaagttgatggaactgtcatgacattggaatctttgcttttctgaaactccattttctcgtccttaggcaagctgaaattctgaaggactgactgaaggcatccacgatcatgcatcttggtgaaaggaatgcttttgttgttctgctggttgctgctctcccaaggcttcaacatggtatttgaagaaatcgattcactgtctcctgctgtattgaacttctccggtttgttctgttgcttcaactgagagaacagggacaatgttggctgttgattcgttaaatttagcagtgggccattgttttcttcagcagctttgtttcctttctctttgttcgccattgtcctgcaaatgtgtacaggtcttcaaattaaatgattattactttctattaaaactgaaataatctagttgttttcctttgtgcctgactatattgcagcatttgtattccattctttataagagatttttttccaccagaaccacaacgattaccttctatcatgaaaatgtaccagaaaatcttaaaccatcaataggatatgcaaaaatggtggaaaaaaatactgtgattcagtctgtagcactaaaatacttgcacgttgagaatattaaaccaagtttaaggatgtattaacctgttcaaactatctgtccaatagctgatactgcctggcttcatttcattaacttttgccttcttgaagctgccctgcccgacagaagatggcaatgagccagcacacggtgtctctttcacagtctttctactttggttttccacaggctttcttgaacggtggcggtttctgttgatgtgcctctcacaatacttgtggtcggccatggcctcctttgaacaccgccatttcttgccatctgttcgacggcatcttccaggttctgggtcagagtctgcatttgggaagccttgatagagaggcctccagccctcgtgccgaattcctgcagcccgaaaaaaacactgtccatcatgagttgcagagaaatacacagatcaatggccttacatacatacatgcacacatgatctttgcttctaacctattgcaagttaataacatggaagtgtgtatgtatgtggtgatgagcaaggccagacctgatggcaatgtgtgagcagccttggcgaatctgagcatcttctgttcatcaagaaagggggaagggtatgatgcagcagcagcctgggtgaagctaccagcagcagctctcttgatgaggctcagatcaccctccttggtggatggcactgtgagtccttgcaagcccaacacctctccaagctccatggcagcagcagagaagtcagcaaacatcttggaaggacaggaggaggggagaggaggaagaagaagaagaggagggggtgagcattgctggggacagtcacagtgaggctgaggttgagagtgaggagggtgtagtgtgtgctttctagtaggaggcaggaagtgtgtggtgatatattatgggatggtggctctttgggagactagaggtagggctaggtggtggcccttaaatagcaggagtcctttcattcttttagtggagtaactttttttgctgtcatttctttattttatttttattttattgattttttgggctcaatgtttctgtgaagtgatactgctgggtactgatggggaggagtaattggttcataaaaaggtagtagtagcagcagcatgtttattctaaaaaaaaaaaaaaaaa

SEQ ID NO: 741 - DNA, 1689 bp, Oryza sativa
atggcgatgccgtatgcctccctgtctccggcggtggccgaccaccgctcgtccccggcagccgcgaccgcctccctcctccccttctgccgctccaccccgctctccgcgggcggtggtggcgtcgcgatgggggaggacgcgccgatgaccgcgaggtggccgccggcggcggcggcgaggctgccgccgttcaccgcggcgcagtacgaggagctggagcagcaggcgctcatatacaagtacctggtggcaggcgtgcccgtcccgccggatctcgtgctccccatccgccgcggactcgactccctcgccgcccgcttctacaaccatcccgcccttggatatggtccgtacttcggcaagaagctggacccagagccagggcggtgccggcgtacggacggcaagaaatggcggtgctcgaaggaggccgcgccggattccaagtactgcgagcgccacatgcaccgcggccgcaaccgttcaagaaagcctgtggaaacgcagctggtcgcccagtcccaaccgccctcatctgttgtcggttctgcggcggcgccccttgctgctgcctccaatggcagcagcttccaaaaccactctctttaccctgctattgccggcagcaatggcgggggcggggggaggaacatgcccagctcatttggctcggcgttgggttctcagctgcacatggataatgctgccccttatgcagctgttggtggtggaacaggcaaagatctcaggtttccagagtgctgcctctttgcccttcccatactttctggtatcagttttcagccccagaagccggggacagtctccataagagatttctgctcaggtgaaactgggtgcttgtgcctgctggtagctgatcatggcttcccttggcatttactccacttctttattcctccacagaatccagttgtttctgtctctgctcttcaggggcagtcaattatttggcccttgcaaaatactgtctctgaagatgtctcaccgatcaccactatacctgaaacattttccagtggccagcttaaaccatggttctatgttttcttatatgaattcatgacaagaatactaacttttggaaaaggtacatgcctagcacttgcattcgtgtttcctactaattcccaatcactgtatcttctcaaattcaggtatactgcttatggcacaagatctttggcggatgagcagagtcaactcattactgaagctatcaacacatctattgaaaatccatggcggctgctgccatctcagaactcgccatttcccctttcaagctattctcagctgggggcactaagtgaccttggtcagaacacccccagctcactttcaaaggttcagaggcagccactttcgttctttgggaacgactatgcggctgtcgattctgtgaagcaagagaaccagacgctgcgtcccttctttgatgagtggccaaagggaagggattcatggtcagacctcgctgatgagaatgctaatctttcgtcattctcaggcacccaactgtcgatctccataccaatggcatcctctgacttctcggcggccagttctcgatcaactaatgcctctgcttgctatgctctcctgtttgtcgactcaacagtgccgtcaacatcagtgcagcaacgtgaggctcatgctttttaa

SEQ ID NO: 742 - DNA, 2181 bp, Oryza sativa
gacaagctgagctagctaagagcgagcttcattaacatacgagacagagaggtcagtgaaggtagcaatggcggcagcctcctctgttcttcgttgctgcctcctcgtcgcagcactgatgacgctgtccgcaatgggagctgaagccatcacaaggcagtacctattcgatgtgcaaacgacgagcgtgacgcggctgtgcagcacgaagagcatcgtgacggtgaacgggcagtacccgggccccacgctgttcgcccgcgagggcgaccacgtcgaggtcacggtcgtcaaccactccccctacaacatgagcatccactggcacgggatccggcagctgctgagcgggtgggcggacgggccgtcgtacatcacgcagtgcccgatccagcccgggggaagctacgtgtacaggttcaccatcaccgggcagcgtggcacgctgtggtggcacgcgcacatctcctggctgcgcgccaccgtgcatggccccatggtcatcttgccccctgccggcgtcgggtacccgttcccggcgccgcatgaggaggtgcccatcatgttcggcgagtggtggaacaacgacacggaggcggtgatcagccaggcgctccagaccggcggcgggcccaacatctccgacgcctacaccctcaacggcctccctggccccctctacaactgctcagcccaagacacgtttaagctgaaggtgaagcccgggaagacgtacatgctgaggctcatcaacgctgcactcaacgacgagctcttcttctccatcgccaaccacacgctcaccgtggtcgacgtcgacgcgctctacgtcaagcccttcaccgtcgacacgctcatcatcgcgccgggccagaccagcaacgtgcttctcaccgccaagccgacgtacccgggcgccagctactacatgctggctcgcccgtacaccaccacgcagggcaccttcgacaacaccaccgtcgccggcgtcctcgagtacgacgacccctgccccaccaccgccgccggcaagatcgtccccatcttctcccctacgctgccgcagatcaacgacaccaacgccgtctccaacttcaccgccaagctccgcagcctggccagcgccgggtacccggcggcggtgccgcagcaggtggatcaccgcttcttcttcaccgtggggctcggcacccacccctgcgccgtcaacgggacgtgccagggacccaacggctcccggttcgccgcctccatcaacaacgtctccttcgtgctcccggcgacggcgctgctccagtcgcacttcgccggcaagtccaagggcgtgtacgcctccaacttcccgtactacccgctgaacccgttcaactacaccggcacgccgccgaacaacaccaacgtgatgaacgggaccaaggtgctcgtgctgccgtacggcgccaacgtcgagctggtgatgcaggacaccagcattcttggcgccgagagccacccgctgcacctgcacggcttcaattttttcgtcgtcggccagggcttcggcaactttgaccccatcaacgacccggccaagttcaacctctacgaccccgtcgagcgcaacaccgtcggcgtgcccgccggcggctgggtcgccatccgcttccacgcagacaacccaggcatgtactctgaaccacatcgattcccttggaggtgcacatgagctggggactgaaaatggcgtggctggtgctggatggcagccgtcctgaccagaagctcccgcctccaccgttggatctcccaaaatgctaggaataaaactcaagatcatatcaatagtcaagattggttgcatttgcatcgcttcacacagaccccacttactgttgtccgatcagatatatattttgctgcttcggtttctcatcgtcgatcgacatgcgtgcttcatttgttgctttttttgataaactgattttctcatgcaattgacagtgtgtttgtcagctagctccggtatttgcatgaagtttcaatttctttcgtattttgaggaaatttgatttctttgattggcagggcttgactcttaggactgcttactgtaactcaaagcgatcgcttgctttgcatcttgtaatgtatcccagtgtattttggtgcaataaaatctagttctggtacattgtccggccg

SEQ ID NO: 743 - DNA, 2189 bp, Oryza sativa
tagcctccctctgcgcagtttccacgtctgcgtggcaccaatcgccggggacgttctcggcctcgtagtcgcgctaggggaacgggtatgggacaccgttcgcggggaggatgacgaaggcgccgtgcacggtggcgcgcatccacgcgatgtgcgcgtgccaccacagcgtgccgcgctgcctcgtcacgtggaagtcgtacacgtagctcccgccgctgccgatcgggcactgcgtcacgtacgacggcccgtccgcccagccgttccgccgctgcttcagcccgtgccagtggatcgtcatgttgtgcttcacgtggttggtcacgttgacgatgacccggtctccttcgcgcgcgtagatggtcggccccgggtagctcccgttcaccgtcaccatggctttctcgtggcacaatctgctcacgttgctcatcacaatatcaaattggtatctcttgacatcggcatgtgcaccgagggcgaaaagggcaagcagtatggcctctgctgcgtccagtctccctctgctggtttcgtctcttctgcttgcccttttcgccctcggtgcacatgccgatgtcaagagataccaatttgatattgtgatgagcaacgtgagcagattgtgccacgagaaagccatggtgacggtgaacgggagctacccggggccgaccatctacgcgcgcgaaggagaccgggtcatcgtcaacgtgaccaaccacgtgaagcacaacatgacgatccactggcacgggctgaagcagcggcggaacgggtgggcggacgggccggcgtacgtgacgcagtgcccgatcggcagcggcgggagctacgtgtacgacttcaacgtgacgaggcagcgcggcacgctgtggtggcacgcgcacatcgcgtggatgcgcgccaccgtgcacggcgccatcgtcatcctccccgcggccggcgtcccctacccgttccccaagcccgacgacgaggccgagatcgtcctcggcgagtggtggcacgcggacgtggagactgtggagaggcagggcagcatgctcggcatggcgcccaacatgtcggatgcgcacaccatcaacggcaagcccggcccgctcgtcccgttctgctccgagaaacatacctacgcgttgcaggtgcagagcggcaagacgtacctcctccggatcatcaacgctgcagtcaacgacgagctcttcttctcgatcgccggccacaacatgacggtggtcgagatcgacgcgacctacaccaagccgttcgccgcgtccaccgtccagctctccccggggcagaccatgaacgtgctcgtcagtgccgaccagagtcccggccggtacttcatggtcgccaagcccttcaacgacgtgcccatccccgccgacaacaagacggccaccgccatcctccagtacgccggcgtcccgacctccgtcgtcccggcgctgccccagacgatgccggccacgaacagcaccggctccgtggccgcgttccacgacaagctgcggagcctcaactcgccgcggtacccggctgacgtgccgctcgccgtcgaccggcacctgctctacaccatcgggctcaacatcgacccgtgcgagacgtgcctgaacaggtcgcgcctcgcggcgtcgctgaacaacatcaccttcgtgatgccgcggacggcgctgctgcaggcgcactactacggccagaagggcgtgttcgccgccgacttcccggaccgcccgccggcgcggttcaactacacgggcgtgccgctcaccgccggcctcggcacgtcgctcggcacgaggctgagcaagatcgcgtacaacgccaccgtggagctggtgctgcaggacaccaacctcctgtccgtcgagtcgcacccgttccacctccacggctacaacttcttcgtcgtcgggagaggcgtcggcaacttcgacccggccaaggaccccgccaagtacaacctcgtcgacccgccggagaggaacaccgtcggcgtgcccgccggaggctggaccgcgatcaggttcagagcagacaacccaggtgtttggttcttgcattgccaccttgaggtgcacacgagctggggcttaaaaatggcgtttttagtggaggacgggagcggtcctgatgagtcggttttgccaccgcccaaggatctgcccaagtgctga

SEQ ID NO: 744 - DNA, 1762 bp, Oryza sativa
gatgcactgcactgcactctcaccagctcttagttctccttcccctgccgctggtcacgcagcaaacatggccgtcctgccggagtcacgccggctctccctgctcctcatggccgcctgcttcctgcttcaggctctcagcgcccacgccatcacccggcattacaagttcaatgtggtcatgcggaacatgacacggctttgctcaaccaagcctatcctcactgtcaatggcaagttcccggggccaaccctgtatgcaagagaaggcgataatgtcctagtcaaggtcgtcaatcatgtacctcacaatgttaccatccactggcacggggtacggcagatccggacagggtggtacgatgggccagcttacataacacagtgcccaatacagccaggaagcagctttctctataatttcactataacagggcaacgaggcacactcctctggcatgctcacatcaattggctaagggctaccgtccatggtgctatcgtcatccttccaaagcttggcgtgccctaccccttccctgcacctcacaaggaggctgttatcgtgttaggagaatggtggaaagaggacacagaaactgtaattaaccaggccatgcagctaggagtgggacccaatatttctgattcacacaccatcaatggtcatcctggtccgctgtctgagtgtgcttcttcacaagatgggttcaagctcagcgtcgaaaatggcaaaacatacatgctccggatcatcaacgctgcactgaatgatgacctatttttcaaggttgctgggcacgaattaactgtggttgaggttgatgcagtctataccaagccatttaagaccgataccctgctcatcactccaggccagaccaccaacgtccttgttagagctaaccaaggcgctggccgttaccttctctcagtctcccccttcatggatgcgcccgtgcaggttgacaacaaaacaggcaccgctactttgcactacgccaacacagtctcgtcaagcatggcatccctcactctcgtcaagccaccaccacaaaatgccacccatatcgtatcaaaatttactgattcactccatagtctcaattccaaggagtacccagccaatgtgccacagacagtagaccactcccttctccttaccgttggcgtaggtgtcaatccatgtccaagctgcatcaatgggacaagggtggtgggcacaatcaacaacgtgacgttcatcatgccatcaaccccaattcttcaagcccactattacaacattccaggagtgttcacagaagacttcccagcaaccccactgcacaagttcaactatacaggaagtggtcccaaaaaccttcaaaccatgaatggaaccagggtttacaggctgccatacaatgcttcagtgcaggttgtactccaggatacgggaatcatatcaccagaaagccacccaatccatttacatggctttaatttttttgtggttgggaaaggggtcgggaactacaaccccaggacctccccttctacattcaacctcatcgaccccatcgagaggaacaccattggagttcctactggtggttggacggcaatcagatttaggtcagacaacccaggtgtttggtttatgcattgtcatttcgaggtgcacacatcatggggactcaagatggcctttgtggtggataatggaaagagacctagtgagactctgattccaccacccaaagatcttccgcagtgttaa

SEQ ID NO: 745 - DNA, 1968 bp, Oryza sativa
  misc_feature (1964)..(1964): n is a, c, g, or t
gttgctactgaagactccggccatggcatcggcagccatgctcgtgccgctcgtgctggttctctgcacggcagcagcaagcgcggccgtcgtggagcacaccttcaaggtgggcggtacgaagatcacccagctatgcatgaacagtgtgatctacacggccaaccagcagctgccgggaccgaccatagaggttaccgaaggcgatacactggtcgtccacgccgtgaacgactcaccgtaccctctgtcactccattggcacggtgtataccagctccggagtggttggaatgacggggccaacaagatcacgcaatgccccatccagccttctggcaatttcacgtaccggttcaacatcaccggccaggaggggacgctgtggtggcacgcgcactcctcgctcctccgagcaaccatctacggcgcgctcatcataaaacccaggaatgggccgagtgggtacccgttccctgaaccatatgaagagatcccgatcctactaggtgagtggtggaacagaaatgtggacgatgtggagaatgatgggtacctgaccggcttagggcctcagatttcagatgcgctcaccatcaacggcatgccaggtgaccagaatcgctgcaaaggttccgccatgtatgaagtggaggtggagtacggcaagacttgcctcctgcgcatcatcaacgctgcagtcaatgtggagctcttcttcaaggtggccggccacaccttcaccgtggtcgccgccgacgccagctacaccaaaccatacgccacggacgtcatcgtcatcgcgccgggccagacggtggacgccctcatgaacaccacagcatcgcccggtcggtactacatggcggcacacgtcttcgacagcaagaccgtcgccgtgccgttcgaccagtccaccgccacgggcatcgtgaagtacaagggcgtgccgaattacgccccggcggccatgccgtccctgccgccccacgacgacgtcgtcaccgccggcagattctactggtcactcaccggcctcgcgcgcccgagcgacccgggcgtgccaacaaccgtcgaccacaacatggtggtgacgttcgggctggaccaggcgccgtgcgcgcccaaccagacgaagtgcagcgggttcgcgctcgtggcggccatgaacaggaactcgttccagttcccggatcagaaggtgtcgctactcgaggcgctctacaagggggtaccgggcgtgtactccgaggacttcccggacttcccgccgccgatgcaggggttcaggaaggcgacggcggtgaagaaagtgaagtacaacgacgtggtggaggtggtgctgcagagcgagcagtacagtagcacgctcggcaccgagaaccacccgatccacctgcacgggttcgacttctacctgctggcgcaggggctcggccggttcaacctgtcgatgaagagcaagtacaacctcgtggacccgcaggtgcgcaataccgtcgccgtgccggccggcggctgggcggtgatccggttcatggcgaacaacccaggtatgtggttcatgcactgtcacttggacgcgcacctgccgttggggctggccatggttttcgaggtgctgaacggaccagccccgaatctgctccctccacctcctgttgaccatccaaaatgccatggatgaacgccttacagattatgtgcgtatatacagagtatactcgacaagttcatgataccaggaatgagattgggtataggggttttcacctgaaaaagaaagatttgagtgtcgcgaggcgtgccctgtattcaaattccatgtgcttcactgctcgtgtggtcattcttttctcatcctgcttgtggttaggacaatcatgttcgaagttcgccactttttaagatttcagtactgaataaaggatgggcttctggagccttctcaatttaaaaaaaanaaaa

SEQ ID NO: 746 - DNA, 1141 bp, Oryza sativa
gtctcggccaccaaacctccccgttgttgcaatcgatcaatgctgctatatataagggacatgctttccgtcgcgtctcgtcttctcatggttgcaactctccaagaatcatctcaagtgtaaacacgtacgcgctgccaaccttatttcccagattatctgatcagtgactccatcgcaatggcttcttgcggcgcttcctgcctgacaattgcggcgctgctgctagcggcgtgcgcctcctccgccgccgccaccagctacaccgtcggcgacgcgtccgggtggacgatcggcgttgattacaccagctgggccggctccaagtcgttcaaagtcggagacagcctcgtgttcaagtacgcgagcggagcgcacacggtggtggaggtgagcgcggcggggtacctggcgtgcgcggcggccaacgcgctcggctccgacagcagcggctcgaccaccgtcgccctcaagacgcccggcaagcactacttcatctgcaccatcgccggccactgcgccggcggcatgaagatggaggtggacgtctccggctcctcctcctcctccagcggcggcggcggaggtggaggtggcggtggctccaccccctcctcgccatcgtcgccaacaccgaccacgccgaatccgtcgaccccgacgccgaccacgccgtatccgtcaaccccgatgccaaccacgccgtatccttcgaccccaatgacgacgcccaccacgccgtacacgactccgacgtctccggcgtgctctggcggcgccggcgccacgccggtaaccccggtgacgccgggcaccgtcccgttcatgtcatacaatggcgccggcgggctcggaccggtggcgctggctaccatcggaatggtttgcttcgtcgtattcgtgcagcttggactgttgtagagtagtagccaggatggaggcagtgcaaagtgatcgtatatgtagtatttagatgtacgtacaaaggtcgcgtcgtgtactgcaatgctaaatgtaatgtgttcattgtattcattgttgtagctgtggagctgaattgctacatctcaagttaccctatttttcagccccatcgtgtggcttataaaatttttataagcgtgttctcaaaaaaaaaaaa

SEQ ID NO: 747 - DNA, 899 bp, Oryza sativa
gcacgagggcgagaaccgatagctagctaactaatcttccccttcgtctccggggggtgattccacgttggacgaacactagctcaccggccgggcatggctgtcttcttccgttctgatcaagctgctcgtcgtcgtcggctgcgccgccgtcgtgcctccgcggcgacgctcaccgtgggtggtagctccgggtgggggcttgggcagaagtacgatacttgggcaagtggccaaaccttcgcggttggagacaagctcgtgttcagcttcgtaggggcgcacacggtgacggaggtgaacaagaacgattacgacaactgcgccgtcgcaagcaactcgatcagctcgaccagcaccagcccagtcaccctcgacctcgccgccgccggcatgcactactacatctgcaccatcagcggccactgcgccggcggcatgaagctggccatcaacgtcggcagcggctccggctccggctccggctccgggacgccacccagcaccaccccaggaagcagcggcacgccgccggccaccccttcttccccctccaagccgaccggcggcgcgtccgccggcctgcaggccagcgccgccgtcgccgccgccgccggcgtcctcgtcaagctcgccctcttctgatcgggcccacctgccaggatagaggcagtgcatatgattcttgtttcttgatcatttcgtctgacggccggcatgcatgtgtgtgagagatgatgatatggggttgttgttccgttccatcgtgtacttagtactgtaattacgagctgtcatgtgatttgttttctcatctccatggatttgtataattttcctctgaattttatcatctgcatattgatcggacactctatatcactctatatcatcttgca

SEQ ID NO: 748 - DNA, 1116 bp, Oryza sativa
gcacgaggattatctgtggccttgtgattggatccaggttgccgggctcgccttttccgcccctataaaacgctcctcgcgttccccctgtctccccacagcgatctctccgaacgaacacacagggtagcgctcgcgtagtcgcgtactccccggcctgctcctcacacagacgcgatggcccagggaagaggcagtgcagcgcaggggctcgccctcggcttgctcctcgtgtgcctcctcgtcggctccgacgtcgccgccgccgccacctacaacgtcgactggtcgttcggcgcggacagctggtccaagggcaagaacttccgcgccggtgacgtccttgtgttcagctacgacccgtccgtgcacaacgtggtggcggtggacgccggcggctacagcggctgccgggagtccggcaccaagtacagctccgggaacgaccgcatcacgctcggccgcggcacgagctacttcatctgcagcttctccggccactgtggcgcagggatgaagatggccgtcaccgccagctgaagaggaagccaacgcagcacaaaagcagggccaggctgctgccgctctagcctgtagctatacatatttacatgtgtcgcccgaacagcaataataagaggcagcagccagcaccgcgtcatcgtgcaggttttgttgtcatagtgcgtcgcaaacaatatatacagggctgtgtgtggggagatatacggagagcggcacgcgacgcctcgagcgccgggcccgaggcggtggtcggacgcagacgctgtaccgaacgagtgccgctatgcaagatcgcgctcaaacagcatacagcacccaagcaagcagatatgatgactgtcacagcctccatcgcccgcccctgggcatgccgctgcacagccggaccgtcccgcgcatgcaccatcactcgtgcccctatccccgcccattcatcgttccacacgcgatgggtgggcccgtcatgcgcgcttccccccgccagcgcaccacacacactacgcctcccatagtatacgtgtgagcggcgaccatagaaagagacaagagtaagaatactcgattcggactctcgcgccctcgcccacccgt

SEQ ID NO: 749 - DNA, 2037 bp, Oryza sativa
gatcgccacacagaaaccttcagggcaagagctatagctaagctactgtgtcacccgttcgatcggtgagccgacgccagcacacgcgccgcaacgtttgcgcttagccggcatggcgtcgtcctcgtcgtcccggctgctcttcctcctctcgtgcagcgtgctcgcgctgctcgccggcgccgaagtgcaccatcatgaattcattgttcaagagacgccggtgaagaggctgtgcaagacacacaacgtgatcacggtgaacgggcagctgccggggccgacgctggaggtccgggagggcgacaccgtggtgatcaacgtcgtcaaccacgcgcagtacaacgtcaccatccattggcacggcatccggcagttcaggacggggtgggcggacgggccggagttcgtgacacagtgcccgatcaagccgggcggcagctacaagtaccggttcaccatcgaggggcaggagggcacgctgtggtggcacgcgcacagctcctggctcagggccaccgtctacggcgcgctcatcatccgccccagggagaacaagacctaccccttcgagaagcccgcgcgagaagtcccccttattctcggggaatggtgggacgcggacccgatccaagtcatcagggaggctcagaggaccggcgccgcgccgaacatctccgacgcgtacaccatcaacggtcagcctggtgatctgtacaactgctccaaggaagagaccacggctgtcccggtgaagcccggcgagacggcgctgctgcggttcatcaacgcggcactcaaccaggagctgttcgtctcgatcgcgcagcacaagatgaccgtggtcggcgtcgacgcgtcctacaccaagccgttcaccacctcggtgctcatgatcgcgccgggccagaccaccgacgtcctcgtcaccatggaccaggcgcccacccggtactacctcgccgcgcgcgcctacgactccgcgcagggcgtggcctttgacaacaccaccaccacggccgtcatcgagtacgactgcggctgcgccaccgacttcggcccctccatcccgccggcgttcccggtcctcccggcgttcaacgacaccaacaccgccaccgccttcgccgcgggcatcaggagcccccacgaggtcaagatccccggccccgtcgacgagaacctcttcttcaccgtcggtgtcggcctgttcaactgcgagcccgggcagcagtgcggtggcccgaacaacactcgcttcacggccagcatgaacaacatctccttcgtcttcccgcagaccacctcgctcctccacgcgcactactacggcatccccggcgtgttcaccaccgacttcccggcgtacccgccggtgcagttcgactacacggcgcagaacgtcccccgctacctgtggcagcccgtcccggcgacgaagctgtacaagctcaagttcggctccgtggtgcagatcgtcctgcaggacaccagcatcgtctcgccggagaaccaccccatccacatccacggctacgacttctacatcctcgccgagggcttcggcaacttcgaccccaagaaggacgccaagaagttcaactacgtcgacccgccacagaggaacaccgtcgcggtgccgacaaacggctgggccgtcatccggttcgtcgccgacaaccctggggtgtggctcatgcattgccatcttgacgtgcacataacctggggcctggcaatggcgttcctggtggaggatgggtatggcaaactggagactctggaggcgcctcctgttgatcttccaatgtgctagtgatcagcattcggcagatgatgatactgcgttaagaatacaaaatcccgttcatgtcgtattccaaattgatgctttttgggggtttattttgtgatctccagtactaggggttgatttttcatcttgatttgagctttcccctgtaaagttaagagtttttatgtgatttctatgcattattttggaataaatcctttttgtagcaagtgttactccaa

SEQ ID NO: 750 - DNA, 642 bp, Oryza sativa
atgaggctctgcttcttctctgccgctgctcttttccttctctgcttcctcgtcccggccgccgtcgccgaggagcgcttctacgagttcgtggtccaggagacgctagtgaagaggctgtgcaatacgcagaagatcatcacggtgaacgggcagttccccgggccgacgatcgaggtgtacgacggcgacacggtggcgatcagggccgtgaacatggcgaggtacaacgtgacgctgcactggcacggcctccgccagctgcggaacgggtgggcggacggcccggagttcgtgacgcagtgccccatccgcccaggcggcagctacacctaccgcttcgccatccaggggcaggagggcaccctgtggtggcacgcgcacagctcgtggctccgcgccaccgtccacggcgccctcctcatccgccctcgccccggcgtcccctaccctttccccaagccccactccgagttccccatcatactagcggagtggtggaggagggacccgatcgcggtgctgaggcagtccatgatcaccggcgcgccgccgaacgtgtccgacgcgatcctcatcaatggccagccgggggatttccttgagtgctccgcccaagatgcttgcaacgtgacaaaatga

SEQ ID NO: 751 - DNA, 1104 bp, Oryza sativa
gtgctatacgcatcttccctagcttgctaagctagctagtcttctccttcctttctcctcttcctcctcctcctcttcttctcaatcttgctcagcaaatcttgtcggggagagagagagagagatcagcaaggagaagagggaattaagctagatcgaggtagtcgtcgatcgatcgattgaagatggggagagggaagattgccatcaagaggatcgacaacacgatgaaccggcaggtgaccttctcgaagcggcgcggcgggctgatgaagaaggcccgggagctggccatcctctgcgacgccgacgtcggcctcattgtcttctcctgcaccggccgcctctacgacttctccagctcaagcatgaaatcaataatagagcggtaccaggaggcaggagaggagcattgtcggttgctgaacccaatgtcagaggctaagttttggcagcgggaggttacaactttgaggcagcaagtgcaaaacttacaccacaacaacaggcaacttttgggagaggaaatctccaacttcacagttagagatctgcagcttctccagaaccaagttgagatgagcctacattccataagaaataaaaaggatcaacttttggcagaggagattctaaaactcaatgaaaaggggtctcttgttcaaaaggagaacagtgaacttcgcaagaagttcaacattgctcatcaacgcaacatagaattacacaagaagcttaactctggagaaagcacgtcaagtgagcaagttaccagaagctcaaaggatcccggagaatcgagtacaccccgtgattcacgtgtgtgtattgaccttgaattgagtcaaaaagaagttgaagatgaataacacatgatcaagtgttaaaaacaacatgatggccagtaacttttgcagcatcacgcctactacaagcgcaagaaaagctagctactactggaacaagggatcttaatcatgttttgaaacttaattagtaatattttaaaaaatcgtactatactaatcatgatgtgtagcgtattgcaccactgaatttattactgtaattaacatggtgagtgttaaaatattttgtgatatc

SEQ ID NO: 752 - DNA, 734 bp, Oryza sativa
ggaaaaggaggaggagatcgaaggggaagatggggagagggaagatagagataaagaggatcgacaacgcgacgagccgacaggtgacattctcgaagcggcggagcgggctgttcaagaaggcgagggagctctccatcctctgcgatgccgaggtcggcctcctcgtcttctccagcaccagccgtctctatgactttgccagctccagcatgaaatccataattgagagatacaatgagacgaaagaagatccccatcaaaccatgaacgcaagttctgaggcaaagctttggcaacaggaggcagcaagcttgaggcagcaactgcataacttgcaagaatatcatcgacagttgttgggacaacagctttctggtctggatgtagaagacttgcaaaatttggaaagtaagctggagatgagcttaaaaaatatccgtctgaggaaggacaatgtcatgatggatcaaattcaagaattaagcaggaagggaagcctcatacatcaggaaaacatggaactacacaagaaagtcagccttgtccatcaagaaaacatcaatttacagaaaaaggttgcggtgcctacagcctagaacaaacttgactatggagtttcaagcagttgggaagcatatgacatgaaagaagacaatataacattacatagcaatatagagcccccaaggcagggaagcaccaaattacagtggctacccagtacctagcac

SEQ ID NO: 753 - DNA, 681 bp, Oryza sativa
atggggagagggaagattgccatcaagaggatcgacaacacgatgaaccggcaggtgaccttctcgaagcggcgcggcgggctgatgaagaaggcccgggagctggccatcctctgcgacgccgacgtcggcctcattgtcttctcctgcaccggccgcctctacgacttctccagctcaagcatgaaatcaataatagagcggtaccaggaggcaggagaggagcattgtcggttgctgaacccaatgtcagaggctaagttttggcagcgggaggttacaactttgaggcagcaagtgcaaaacttacaccacaacaacaggcaacttttgggagaggaaatctccaacttcacagttagagatctgcagcttctccagaaccaagttgagatgagcctacattccataagaaataaaaaggatcaacttttggcagaggagattctaaaactcaatgaaaaggggtctcttgttcaaaaggagaacagtgaacttcgcaagaagttcaacattgctcatcaacgcaacatagaattacacaagaagcttaactctggagaaagcacgtcaagtgagcaagttaccagaagctcaaaggatcccggagaatcgagtacaccccgtgattcacgtgtgtgtattgaccttgaattgagtcaaaaagaagttgaagatgaa

SEQ ID NO: 754 - DNA, 723 bp, Oryza sativa
atggggagggggaagatagtgataaggaggatagacaactcgacgagcaggcaggtgacgttctcgaagcgtcggaacgggcttctgaagaaggcgaaggagctatccatcctctgcgatgcggaggtcggccttgtcgtcttctccagcaccggcaggctctatgagttctccagcaccaacatgaaaactgtgatagaccggtataccaacgcaaaggaggagctacttggcgggaatgcaacttcagaaattaagatttggcagagggaggcagcaagcttgaggcagcaactgcacaacttgcaagaaagccacaagcaactgatgggtgaggagctttctggcctaggtgttagagacctacaaggtttagagaataggcttgaaataagtctacgtaatatcagaatgagaaaggacaatcttttgaaaagtgaaatcgaggagttacatgtgaagggaagcctaattcaccaggaaaacatcgaactttctagaagcctaaatgtcatgtcgcaacaaaaattggaactgtataacaagcttcaggcctgtgaacagagaggtgccacagatgcaaatgaaagttccagcactccatacagctttcgtatcatacaaaatgctaatatgcctcctagtcttgaattgagccaatcacagcaaagagaaggggagtgcagcaaaacagctgctccagaactgggacttcatctgcct

SEQ ID NO: 755 - DNA, 705 bp, Oryza sativa
atggggaggggcaagatagtgatccggcggatcgacaactcgacgagccggcaggtgacgttctcgaagcggcgcaacgggatcttcaagaaggccaaggagctggccatcctgtgcgacgccgaggtcggcctcgtcatcttctccagcaccggccgcctctacgagtatgccagcaccagcatgaagtcagtgattgatcgatatgggcgagctaaggaggagcagcagcacgtcgcaaaccccaactcggagctgaagttctggcaaagggaggcagcaagcttgagacaacaactgcacagcttgcaagaaaatcatcggcagttgatggggcaagatctttctggattgggtgtcaaggaactgcaaactctagaaaatcagctagaaatgagcatacgctgcatccggacaaaaaaggaccagctcatgattgatgaaatccacgaactgaatcgaaagggaagtctcatccaccaagaaaacatggaactgtacagaaaggtcaacctgattcgccaagaaaatgctgagctgtacaagaagctctatgagacaggggcagaaaatgaagcgaatcgagattcaacaactccatacaactttgcggttatcgaggaagccaacactcctgctcgtcttgaactcaatcccccaagccaacaaaatgatgctgagcaaaccacacctcctaaactaggg

SEQ ID NO: 756 - DNA, 567 bp, Oryza sativa
atggggagagggaagatagagataaagaggatcgacaacgcgacgagccgacaggtgacattctcgaagcggcggagcgggctgttcaagaaggcgagggagctctccatcctctgcgatgccgaggtcggcctcctcgtcttctccagcaccagccgtctctatgactttgccagctccagcatgaaatccataattgagagatacaatgagacgaaagaagatccccatcaaaccatgaacgcaagttctgaggcaaagctttggcaacaggaggcagcaagcttgaggcagcaactgcataacttgcaagaatatcatcgacagttgttgggacaacagctttctggtctggatgtagaagacttgcaaaatttggaaagtaagctggagatgagcttaaaaaatatccgtctgaggaaggacaatgtcatgatggatcaaattcaagaattaagcaggaagggaagcctcatacatcaggaaaacatggaactacacaagaaagtcagccttgtccatcaagaaaacatcaatttacagaaaaaggttgcggtgcctacagcc

SEQ ID NO: 757 - DNA, 1311 bp, Oryza sativa
atcaaattcccctataagctttggcctctttgcagctttcttctaccagctcccagctagatcccctcttgccttctttggcacattcgttcttgctctctgctgtggattatttgcctccggctccggccaatcggcggcgtggcgcgggcagatcgatcgatctcatcggcggcggggattgcctgttctagctatagcttgatagcttagctagcttggtcatttctggtgagagatcgatcgagatagcggcgaagaagatggggagggggaagattgtgatccgccggatcgacaactcgacgagccggcaggtgacgttctcgaagcggaggaacgggatcttcaagaaggccaaggagctggccatcctctgcgacgccgaggtcggcctcatgatcttctccagcaccggccgcctctacgagtactccagcaccagcatgaagtcagttatagatcggtatggcaagtccaaggatgagcagcaagccgtcgcaaatcccaactcggagcttaagttttggcaaagggaggcagcaagcttgagacaacaactgcacaacttgcaagaaaatcatcggcagttgatgggcgaagatctatctgggctgaatgttaaggaattgcaatctctagagaatcagctggaaataagtctacgtagtgtccgtacaaagaaggaccacgtcttgattgatgaaattcatgaactgaatcggaagggaagtctagttcaccaagaaaacatggaattatacaagaagatcagtttaattcgtcaagaaaatgctgagttatataagaagatctacgagactgaaggaccaagtgaagtcaatcgggattcaccaactccttacaattttgcagtaattgaaaaaacaaatgttcctgtgcaacttggactcagcacactaccacaacatagtgacgccgaacaatcaactgctcctaagctagggttacagttgaatccatgaccagaaaaacattgttttgctacacccttgtatgctgaagggatactatttgctgtcaagagttgatactcagatcaagaaaaaaaaaactattcatgccatagtgattgagaaatggacttgtatactggaaataaatgccacagtggaattgagttgtggaatccaggcaatgagtgttttatagattcaatttttccatgtatttttcatatattaaccagagcgggcttgtgtaaaaaatataaccaggcaaggaaaattagctgtattgtgcatatggagcaaatttcaggcgttactaccattaaaatcatgacatgct

SEQ ID NO: 758 - DNA, 2204 bp, Oryza sativa
atgagcgggagcggcggaggcggaggaggaggagccggcggggacggcgcgagggcgctggaccagacgccgacgtgggccgtggcggccgtctgcgccgtcatcgtcgccgcctccatcctcctcgagggcctcctccaccaccttggccagtggttcagcaagaggaggaagaaggcgctgttcgacgcgctggagaaggtcaaatccgagctgatgacgctggggttcatctcgttgctgctcagtgtcacggggaggtacatatcgcgcatctgcatcccggtgggagccgcggacaccatgcttccctgcagcctccggaggagttcttcagagcaggaggtgcccggtggtggtggccatggccggcgacacctatctggagatccaaccaattttaaatgcgccaaaggtatggtgtcgcttgtttcagctgatgggcttcaccagctgcatatcttcgtgttcttcctggcagtctttcatgtcgcattcagtgctattacaatgtctctgggtagagcaaagacacgtatatggaaggagtgggagaaggagacttgctcccttacctacgagttttcatatgacccctcaaagttcaggcttactcatcaaacgtcttttgtgaggcaacatgcaagctgttggagcaaaagtactattctgctctattttgtgagcttctttaggcagttcttcagatctgttagaaggacagactacctgactttgaggcacggattcattgctgctcatttatctctagggactaggttcaattttcggaaatacatcaaaaggtcactggaggacgattttaagacagttgttggcattagtgcacccttatgggcttctgcgttggccattatgctcttcaatgttcatggatggcataacttgttctggttctctacaatcccccttgtagtaactttagcagttggaacaaagctgcaggctataattgcaatgatggctgttgaaattaaagagaggcatacagtaattcaaggaatgccggtggtgaaactcagtgatgaacatttttggttcgggaagccacgtctggttcttcatcttatccatttcgcgtcatttcagaatgcatttgaaattacatacttcttttggatttggtacgaattcgggttgagatcctgcttccatgacaactttgagcttatcatcgccagagtctgccttggggttgtcgttcaattcatgtgcagctatatcacacttccactctatgctctcgtatctcagatgggttcacagatgaagagaacgattttcgacgagcagacggcgaaggccctgaagaaatggcacaaggcagcagtggtgaagaagaagcagcagaaggggtcatcccatgagccaggttcagagacaccgggcacggagacgacgacgacgacggcgacggcaacggaggagagccagcgagaacgcgacgccgcggccatgccggtgcgccacctccaccgctacaagaccatcgcccacgtcggcgcgacggggacgctgtccgactcggactgctccgacacggacacgccgttcgcgtcgccgacgaggctcctgataccgccgacaaagcagcggagcctcgacgccgggagggcggaggtgcgcgtggacgtcgactcgacgccgacgccgacaccaccggagcgccatgacagcttctccttcccgaggttgcctgctcacaatttgcagcagaaatgaccaaatgatcatccatcctaagttcctaaccatcagtagtagtagtagcagcatcaactatacatgtaattgaaattgatggtggtgacaagtgtgtgtagagcagtggagtctgaaacttggtgctgtcccatttggtccagctcctactctgtgggtggagcggagctgagaaaatgccatttcacgtacttcctccgtttcacaatgtaagtaattgtaacatttctcacatttaaattgatgttaatgaatctatatagatatatatgtctagattcattaacatcaatatgaatgtgggaaatactagaatgacttatattgtgaaacggatgaagtataatttccggtttggcagctgtttggcagctccactctaatactttatgttatccatgattttgaaagtgtttggtacagagccacagatataagaatatccgagcatgagttatgcc

SEQ ID NO: 759 - DNA, 846 bp, Physcomitrella patens
atgggtcgcggcaaaattgagatcaagaagattgagaatacaaccagcaggcaggtgacattctccaagaggcgcggtggtcttttgaagaaggcgcacgagcttgcggttctgtgtgatgccgaggtggcgctggttattttctccagcactggaaagcactttgagtttgccagttcaggcagcatgcgggacatcattgagcggtacaggaagagctcggatggtgcagtgaagcgtggcaccaatactgatttacttggtcgggaggtgattaagttaaaacagcaagtagaacgattggaaagctctcaaaggcatatgcttggtgaggatctttcagctttgaaggtatctgaccttttggagctggagcagcagcttgatcagggtgcttcacgagtgagagcaaggaagaatcaactcattttagaagagatcgaagacttgcggagaaaggagcatgaactgatgattgcaaacgaggctcttcgcaagaagattgcagacgctgaaggtgctgcggaagcagcagctagagctaatttcccggatgctcggctagaaagccccaaaccgttcgccagcgatttctcacgagatatgagtgtgagttcgcagctggcagcatcagtctaccctcatcccaaccttctacaggcgcaaagatcacagacgtcattacagcttggatggctatctgagcaacagatccccagcacggaagaaggttgtgcaggtgaatctagcttgaaatgggatcatccgcactttcacattcagaatagactccatgcaaacatatcaccaagtgtgagaacttataagttacatgtcgatcgataa

SEQ ID NO: 760 - DNA, 649 bp, Sorghum bicolor
cacggggtggaggcgggcaacaatcccgcggagctggcggcggccgtgggtggcgcctccagcagctcctcccgggcggcggcgaggagcagggtcgcggcggctgctggcgcctccggctcctccccggtggcggcggcgaggagcaggggcgccggcgccgtggccgcggcggcgggcggcggcggtggcgtcgggccgagctgccaggtggagcggtgcaacgccgacatgggcgtggagaagcggtacaaccggaggcacaaggtgtgcgacgcgcaccgcaaggcgtccgtcgtcctcctcgccggcctccgccagcgcttctgccagcaatgcagccggttccacgagctgtcgcacttcgacgacaccaagcggagctgccgcctgcgcctggcggggcacaacgagcggcgccggaggaacccggcggaggcgcacgaccagaacggcggccggggcgacccggggaaccaccacctccacatcagatcagataaacctatctaagcatgctctctctcttctgtcatgcaggatgcacctagcatcaccgatcgataatccgatttgtgtctcagtgcctaccctgtcctgtgtctgtgtgttgcgtatggtacgtgctgctgctactacgtgctaactt

SEQ ID NO: 761 - DNA, 670 bp, Sorghum bicolor
cgcggccccgccgcccgagagcagcagcagcaacaagatgttctccgacgggctcacccccgtgctcgactcagattgtgctctctctcttctgtcatcccccgccaactcctccagcgtcgacgtgagccggatggtcgtccagcccgcggcggagcacatccccatggcgcagcccctcgtccccagcagcagcctccagcaccaccaccagcaccaccagttcggcagctccccgggcggctggttcgcctgctcccaggccggctccagcgccgtctccggcgcgggcaccggcaccggcggcttcgcctgccccgccagcgtggagagcgagcagctcaacaccgtcctggtgcccagcaacgacgccggccacgagatgaactaccacggcatcttccacgtcggcggcgagggatcctccgacgggacgtccccttcgctcccgttctcgtggcagtagcttcttccgtccggttcaagcgaccagtagtgatcggtgttcagctgtagtgatcctgttctttctgtgtttatttattattattattctccctgtcatttgctcgtttcttcgttttgcatgcctgatgcatgcagcctgaaaaaactcgcataaaattagtgccgaatttctcctgaaaccgttctgatatcttactgattc

SEQ ID NO: 762 - DNA, 1467 bp, Sorghum bicolor
cccatctcttcttctccacagtccacactgttcacctcctctcccctctcctcctctcttcgatccccaaatccggaattgaccagcccaaatcgtcgtcgccccggccgcatggagtggacggccccgaagcccgcctcctcgccctcctcgcctccccttctctgggactggggagaccacgccgccacgggctcgggctcctcctccggcgacgccccggcgcggcgcggtgctgggaaggagcgggaggcgaagcgtgccaggggcgaggacggcggcgggggagctgaggtgaggtgtcaggtcgaggggtgcggattggacctcaccagggtcaaggactaccaccggaagcaccgcgtctgcgaggcccacaccaagtccccccgcgtcatcgtcgccggccaggagcgccgcttctgccagcagtgcagccgattccatgccctgtcagagtttgatcagaagaagaggagctgcaggaggcgtctgtctgatcataatgcccgccgccggaagcctcagccagatgcattcacctttgcctctgcaaggctgccttcgtcattgtttgatgataggaggcaaataagttttgtctggaataaagctcctgttagtcatgtaaggcctttcacttctccatgggacagttcatctgacttaaagctccctcatgcaaaggaaacaagagaggtatcaacaaaagttgggacaattacgggacaagttcatttggataaatctcacatgtccaatgctattccaacacttagtcatggcaaagatgagccttggccaatgaaaggtccggacatgtctataactgcttcaaaatttgatggagcaccggatcttcagcgtgctctctctcttctgtcagttggcgcttgtggattgcctgatcctgtacatcaaacatcctgcgttatccaattcactggtgccagcgagaacagtggtgaccttcatttatcacatggggggaactctggtccagcttcatgcgctgatggacagcatatagctgctcagtctcagtctcagctggttcgttttaccatggataccagcaacaatgtctatgagcccagtttcttcggtgtaaaccagataaattaagcgtgaaagatacacgccagttgatcatttggataaatagccatgaagatggcctgggcttgtgcaggaagttcttcaaccaaccaccggacataaggatctctcagttaatgttatctgcatatttatcagcttatgtttaatatgcagttccaacctgtgattgacccattttttctgttgttttttttgccccctgtgatgtgacgactctggaactttctaagtgtgatactatgtagttttacacttttattttactgccctgatgatgatgatgatgatgatgtcaacggttggatatctttaaactgtccttgatgaatctggacatgttttttt

SEQ ID NO: 763 - DNA, 645 bp, Sorghum bicolor
ctcagttgccagggcgtactgacaatgaaattaaaaattactggaacactcgaataaagagatgtcaacgagctagccttcctatctatcctgcaagtgtatgcaatcaatcttcaaatgaagatcagcaagtgtctggtgattataatggtggcgagaacatatccaatgatcttctatccgggaacagcctttatctaccagattttaccagtgacaatttcattgctaatccagaggctttatcatatgcaccacagctgtcagctgtttcaataagcaatttactcggccaaagctttgcatcaaaaaactgtagcttcatggatcaggtagaccaagcagggatgctgaaacaatctagctgtgtgcttcctgcattgagcgatgccattgacggtgtgctttcttcagttgatcaattttcaaatgactctgagaagctcaagcaagctttaggttttgattatcttaatgaagccaatgctagcagcaagagtattgcacctttcggggttgcacttactggcagccatgcctttctaaatggcaacttctctgcttctaggcccacaaatggtcctttgaagatggagctcccttcactccaagatactgaatctgatccaaatagctggctcaagt

SEQ ID NO: 764 - DNA, 663 bp, Sorghum bicolor
tgtcggccttcttgaggatgaggagagtaagatgatcaagggtcctggtgggtacatgagaggcagggggaaggtcaagatcacggatgttgttgaggccgcaagccttgcggccagcggccaaccatttgaggtggtgtactacccgagagctagcacaccggagtttgttgtcaaggcagcatcggtgcagaacgcgatgaggaaccagtggtgccctgggatgaggttcaagatggcatttgagacagaggattcatcaaggatcagctggtttatggggaccatagcttctgctcaggttgccgacccaatcagatggccaaattcaccgtggaggcttcttcaggtgacatgggatgaacctgacttgctgcagaatgtgaaatgtgtcaatccatggcttgtggagattgtatcaagcattccacccattcacctgggaccattttctccacctagaaagaagttgcggatgccccaacatccagactttccatttgacggtcagctgttgaatccaattttccacggcaacccacttggtccaagcaacagcgctcttcgctgtttctcggacattgctcctgcaggcatacagggagcctggcatgctcaatttggtttacccctaacagaccaccagcttagcaagctgcacct

SEQ ID NO: 765 - DNA, 1416 bp, Sorghum bicolor
tggtagaatcgatccatcttgcagaagcagctccatatctatccatccaggcctgcagctgcccggccggccgcagggatagcacctagcgcgggcgcgggaggggagtgcttcttgagatcgatcgatcgatcgagctgtgtgtgtgcgcgcgcgcgctgcttgccgcgcgcgacgacgacgcgatggccatcaactcgctgagcatggtggaggccaggctgccgccggggttcaggttccacccgcgggacgacgagctcgtgctcgactacctcgccaagaagctcgccggcggcgccggagtcggcggaggcccgctggtggtgagcatctacggctgccccgccatggtcgacgtcgatctcaacaagtgcgagccctgggaccttcccgaaatcgcgtgcattggtggaaaagagtggtatttctacagccttagagatagaaagtatgccaccggccagcgtacaaacagagcaactgattcaggatattggaaggccacggggaaagaccgtccaataagccggaaagggttacttgttggtatgcgcaaaactcttgtgttttatcaaggtagagccccaaaggggaagaagaccgagtgggttatgcatgaatttcgcatggaagggcaaggtgatcccatgaaattacctttcaaggaggactgggtcttgtgtagagttttctacaagagtagggcaacagttgcaaagccacccacagagagtagcagcagcttcaatattgatgctgccacaacttcattgcctcccctcattgacaacaactacaatatttcctttgatcagcctggctcatcagtgcaaaacctagagggttatgagcaagtgccctgcttctccagtaacccctctcagctatcgtcatcgataaacgctccgctgtcgtctgccgccaccatggctgatccggagcaacacatggggaagtcaataatcaaggatgttctcatgagccagttcagcaggttcgaagcaggcaacgtcaagagggaggcgcctcaaagcaatttttctcaggatgggtttgagtacttagctgagagtggattcacacagatgtggaattctttcaattaattgattctataggaagatgattattgccatggagggtgatacggatcggaattcctcgacaacaaaaggagggatatatatatagatgaatgctaaagagggcttgggtgtgtgtgccttctgtgtggtattgcatgtagctgtagtaggtatatatatacatatagtagtactagtaccatctcagtacacattcgtcaaaaagaaggagaaatgagaagagatatatatatgttatatgccttattatgccatcaatgacgacagatgtaaatatattatttgtgtactatggagaaattagaag

SEQ ID NO: 766 - DNA, 1158 bp, Sorghum bicolor
gccccgggctgaaactgcagcagatagtagggtagaagatgagctcgtcgatcagcatgatggaggcgagaatgcccccggggttcaggttccatcccagggacgacgagctcgtgctggactacctcctcgacaagctctccggccatggccatggcggcggcgcagccatcgtcgacgtcgacctcaacaagtgcgagccatgggaccttccagaatctgcgtgcgtcggtgggaaggagtggtacttcttcaacctgcgcgaccgcaagtacgcgacgggtcagcgcaccaaccgcgccacgcgctccggctactggaaggccaccggcaaggaccgcgccgtcgtcgccggcggcgacggcggcgaggatgcggcggcggtggtggggatgcgcaagacgctggtgttctaccggggccgagcgcccaaggggaggaagacggagtgggtgatgcacgagttccgcctccatccacacgccgcgccgtccctaccagctgcggcaacgaaggaggactgggtgctatgcagggtgttctacaagagcagaacaaccaccccaaggccagcatctgacgatgcccaggacggcaccccatcagctgagccacaactgtctgctgccctgccgcttgggccgctggctgacacatacactgccttcggtggtgccccaacggtttttgagcaggtgtcctgcttctccggtctgccagcactgccgttcaagagaccagtgagccttggggaccttctggcgttcgacacctctgagaaggaatccatcgggacagtgatgagcagtgtctcaaacaacagtagttcagtactggagctgactccaaattgcaactggaaccaggaaaatgacatgttacagatgtggaaccccctagggatatgagatagatctgtgttgtttcgttgatagtggttgtgaagtgctgtcccaggtctggagtgctagtactgagtgtacatgcagattaaatttgattagtagtgtgacatacagattacagattagattattcattattggactaatggcttggcgtagtatttgtacataggattgctaatgaaggaaccgtgtccttgtatcttgttcagttgttcatatttctctgttctcaaaatatgtttctaagtgc

SEQ ID NO: 767 - DNA, 897 bp, Sorghum bicolor
ctccactctctcccggaaaaatccatccgtccataaaacccaaaaagtctcatcaggtttagttgcaaagcagcgatcaaaagcaggcctagacgacggcgatcctcagctcagtagccaggcaggagatggagcacgacgtgcaccaccaccaccatcagcagccggaggaggccatggagctgccgccggggttccgattccaccccaccgacgaggagctcatcacgcactacctcgccaggaaggccgccgacccccgcttcgccccgcgcgccgtcggcgtggccgacctcaacaagtgcgagccatgggacctgccagctgacgacgccaccggcaccacacgtgacctgcttctccaacacgctggagggccacttcctgaccccaccaacctgcctcctcccctccgccgccgccgcctccgccgcctcgccgttcctggcgagcatggcgcagtacgacggcgacgcgggcgtgggcggcatggtgcacgagctcctgcaggaggccggcgggtggtacagcaagctgggcgagagggagcggctgagcggcggcgcgtcgcaggacaccggcgtcacctcggaggtgaaccccgccgagatctcctcgacgcggcaccacatggatcacgaggcctccttttggggcttctgatgaactcccccgtcttttccgttatcgttaaaaaaatggattagaattagtcactggattggaaatggagattgtattgtgctattgaatgaatactgttatgtgcaaatggggcaaaaaaaaaaagttgtgaacaaagcatatatgcttgtgtagtactaaatcgatttggttttagaggaactcagcgtgtaattgttacgtgaacacttagataatctcgtagcgtatatc

SEQ ID NO: 768 - DNA, 1650 bp, Sorghum bicolor
ctggaatcttccccttaaaactccactctctcccggaaaaatccatccgtccataaaacccaaaaaggttagcagcctccttttctccatctcccagatccgcactgtcgctgatgctacctgcgatctccagctgctgtttctttattatgtgttcgatctccacatgtactgcctgcatcgatcgatacgattcagcgctgttgattgttcaattttggttcatgtagctggccacgtacacaatttgatttgattttgcctgattttcttggagtaccaaataatcttggtcaggtcgtcgttgtttatgctagctgcagacgagtgacgagtactactgtttaattctctgtgtgtttatgcatctcagtctcatcaggtttagttgcaaagcagcgatcaaaagcaggcctagacgacggcgatcctcagctcagtagccaggcaggagatggagcacgacgtgcaccaccaccaccatcagcagccggaggaggccatggagctgccgccggggttccgattccaccccaccgacgaggagctcatcacgcactacctcgccaggaaggccgccgacccccgcttcgccccgcgcgccgtcggcgtggccgacctcaacaagtgcgagccatgggacctgccatatcgggcgacgatgggggagaaggagtggtacttcttctgcgtcaaggaccgcaagtacccgacggggctgaggacgaaccgggccaccgagtccggctactggaaggcgacgggtaaggacagggagatcttcaggggcaaggccctcgtcggcttgaagaagacgctcgtcttctacacggggagggctcccaggggcggcaagaccggctgggtcatgcacgagtaccgcctccatggcaagcacgccgccgccgccgccgccgccagcagcagcagcagcctcatcccgtcggtcagagctggcgcgtcaaaggacgactgggtgctgtgcagggtgttcaagaagagcatcgagccgccgtcgtcagtggccggcggcagcaagaggtcatcatcatcggttgcgtgcatggggatggaggacgtcgtggggccgtccaggtccatggcggacgacttcgccgcgtccacgctgcccccgctgatggacgtgtccggcggcagcggcggcaacatgtcactttcagcggcggcggcggctgcggcgtccatcgagctgacgacgccaccggcaccacacgtgacctgcttctccaacacgctggagggccacttcctgaccccaccaacctgcctcctcccctccgccgccgccaccgcctcgccgttcctggcgagcatggcgcagtacgacggcgacgcgggcgtgggcggcatggtgcacgagctcctgcaggaggccggcgggtggtacagcaagctgggcgagagggagcggctgagcggcggcgcgtcgcaggacaccggcgtcacctcggaggtgaaccccgccgagatctcctcgacgcggcaccacatggatcacgaggcctccttttggggcttctgatgaactcccccgtcttttccgttatcgttaaaaaaaattggataagaattagtcactggattggaaatggagattgtattgtgctattgaatgaatactgttatggc

SEQ ID NO: 769 - DNA, 774 bp, Sorghum bicolor
cttcactccactccccactcccacccacgcgagcacacccaccacctactcctactccccatggcaggagcgcgcacgggagccggctgctgctccacctcctctcctctcctgctgcactactaggcggtgcccgccggcgacgacgatggcgatggtcgcgagcagggagaggcggctctccccgccgggcggcgccgcccagggcgcgccgcaggtggacgcggccaagtacgtgcggtacacgccggagcaggtggaggcgctggagcgcgtctacagcgagtgccccaagcccagctcgctccgccggcagcagctcatccgcgactgccccatcctcagcaacatcgagcccaagcagatcaaggtctggttccagaaccgcagatgccgggagaagcagcgcaaggagtcttctcgtctacaaaccgtgaaccggaagctgagcgcgatgaataagctgctgatggaggagaatgaccggctgcagaagcaggtgtcccgtctcgtctttgacaacgggtatatgaagaatcgactccacagtccttctgtagccaccaccgacacaagctgtgagtctgtggtgacaagtggtcaccacaaccaacagcaaaacccagcagttctgcatcctccacaaagggatgcgaacaacccagcaggtctactcgctattgctgaggagacattggcagagttcatgtccaaggcgactggaactgctgtcaactgggtgcaaatggttgggatgaagcctggtccggattc

SEQ ID NO: 770 - DNA, 752 bp, Sorghum bicolor
ccctcgggagatcgctcgatatcaccagattcagcagctactacgagttacgtagcgagctcgagcggttatttggtcttgaaggccaattggaggaccctgtaagatcaggctggcagcttgtattcgtcgaccgggaaaatgatattcttctcgtcggcgacgacccgtggcaggagtttgtgaatagcgtatggtgcataaagatcctctcgccacaagatgtgcagcagatggtccgcggcggaggcgaccttctgtctgcacctggagcgaggatgctgcagagcagtgtctgcgatgactattctgcaggccacgacatgcagaacctcaccggcatcattgcacctgtggtgcctctggactactgagactgagatgaagaccggaatctgaagttctgaaccaaaaccagcaattcagcaccggaggattgccatccacaagtcgtttcagttcctatgatcttctctcatgtcctgttggtcagaaataacctagtcattaatatagctagatgagatgatcccttgtatcattatggtaatggacatgttgtacgatagctactgtagctatgtgatagccatagcctaagctctaaatggcagggaagaattgttctatgaaagtatgaatgcaggcactcactgtagaggtgatctagccctgtagttctctatattatcttatatcgaaaactgatggttccttgtggcgcctaaactattgaaacctgtcaccttgtc

SEQ ID NO: 771 - DNA, 917 bp, Sorghum bicolor
  misc_feature (260)..(260): n is a, c, g, or t
cccacgcgtccggagctcttcacagaatgatttccccttgaatcaatcactacatagtgcgggctgcttagatgagtcaggttatgctccatgtgcagagaattctgaacaagcaaatcaacagtttgcaacctttgtcaaggtttacaaatctggaaacgtgtgaaggttgctggatatcactagattcagcagctatgatgaacttcgtagtgaggtggggcgtctatttggccttgagggccagttggaagaccctntgagatcaggctggcagcttgtatttgttgacagagaggacatgtccttctagttggcgatgacccgtggcaggaatttgtgaacagcgtgtcctgtataaagatactttcaccggaggaggttcagcagatgggcaagccgggcattcagctcttgagctcggctccttcaagaaggctgagcaatggctgcgacagctatgcgagcatgcaggaatcaagaagcctgagcactgggatggcgccagtgggttcggtcgagttctgaagacagggatgccccatagcccttggctttaggattctccttctgtatgtttctgcagcactagctagttttgcgacttggaacaaagcacatagatcaaacgagctctatgctattccacgtctgatgatgtcctatggtacaggtgccagccatatctggaaaattttgttggtcacctgctgtcgagtatccaactgtggatgcttcgtgctcgtgcccccagctcgccttcttctgccgtgcctgccccctccccgacgtcactattttacgaacgttcagccgaaacgaaaccagcggtcaattcccgacagccatttctttccatttttggaaaatgtatatgttactttttatttttagacagaacaggaatcattctattc

SEQ ID NO: 772 - DNA, 712 bp, Sorghum bicolor
atgatccggcagctagaacttcgttaaggttacaagtcaggatcagtggggagatccttggacatcacccggttctctaattatgctgaacttcgagaggaactgggtcagatgttcggcatcaagggtcagttggacgaccctgatagatcaggctggcagcttgtatttgtcgacagggagaacgatgtgcttctccttggagacgacccatgggagtcatttgtgaatagtgtatggtacatcaagatactttcaccggaggatgtgcataagatgggaaagccaggaaatgatccacgctacctatcttaaattgatacacggagctctttctggctcccatgacgaattctgcagcacactgtagcactgttcatgatggcctgctctactgtgctcgcatgttcgcccgtgtcatctctagcatgtacaccgtgcacgtcttcagaactccccgttacttgtatccggtgcaggccaccgctctggactgatattttgtaggttccacttaggaatcagtatcagcaactctatcctagttggtttgtagcttgcacggcacccgtccttgtgtcgcgtaaaaatcttcagactaaatgcttagttgaaattgttgtcgtgattcgtaagttatctatgtatttgaggagtcctcgacatgctttcgacgatgaactgcaataatttgaatgcaggaggattgtgg

SEQ ID NO: 773 - DNA, 806 bp, Sorghum bicolor
ccattacctcttgaagtatccgaggagcctgttttatgtaaatgccaagcagtaccatggtattttaagacgacggcagtcacgtgccaaggctgaacttgagaaaaaggtggtcaaagccagaaagccataccttcatgagtctcgtcatcagcacgcgatgaggagggcaagaggaaatgggggacgcttcctaaacacaaagaaaagtgacaatggtactcccaatggtagagctgagcctaagaaaggagatggtaactccgagcatctccatgtccctcctgacttactacagctacgacagaacggggcttgaagtagcgttctggctctggcatcctagaacagcagtttctgcccacaggcataggcatttgaaaccggactcgtagctccacagtatgcgcagccatatctgcggtaacgctcgttcacctgaatgagctttgtaccgaggtaggcatgcaatgcaatctgggcgcaggagtccatcaggtgtccaatgccatatgggtgtatgctgtttcaggcaattcattcttggctttcacgttccaccacccatgtgtagcgctagtgtgttgtaagtgaaactaagcttgtgctctgtattgggccgttcggcgaaactgtgaaacatctgtataattaagatcgaactctggattaactcggtagtgctttgtctggtttttcttttagcttttgaactgtaacacggccacagctgaactcatgttggctttgttcgttgctcagcaacgtcggtcttgtactcttgtactgagtattcatgtgcttgc

SEQ ID NO: 774 - DNA, 1435 bp, Sorghum bicolor
gcacgagggatccagcgccgcccaagagagggacacctgaggtcctcaaattctctgtcttccaagggaatttggagtcaggtggtaaaggagagaaaaacccaaagaattctaccacgattgctctgcagtcaccattcccagaatacaatggtcgtttcgagatcggtcttggtcaatctatgatggtcccttccaattattcttgtgctgaccagtgctatggcatgcttacgacttatggaatgaaatcgatgtctggtgggagaatgctgttgccactaaatgcgccagccgatgcacccatctatgtgaacccgaagcagtacgaaggcatcctccgtcgtcgccgtgctcgcgctaaggcggagagcgagaacaggcttgccaaagggctgcagccctatctccatgagtcgcgccacctccatgcgatgcgtcgggtgagaggctccggcgggcgcttcctcaacacgaagaaagaaggagggcatggcacggacgttgatgcgaatgggggcagcaagatggcagcagcagcaccatcacgcctcaccatgccccctagctccgagcctccacgaccaccagggctcagcaacattagcaacccgcacttccactcccagagtagcgtctccagcttgtctggctccgatgtgtcaaacatctacggcggcttggagcagccccctcgggcgccacccttcttcaccgtgctgccacccatcatggacggcgaccatggtggcgtcacccacatctcttccttcaagtgggcagccagcgacagctgctgcgagctcctcaaggcatgaaccgaggaggaggggatggctactcagacaaacggccttctccccgatggctggtagtctgtaggcaaatcattcttggctgttctgcattggggtgcaacctccacatcatctacctacctacccaccccctgtccctgaaattccacagtgctttgggttacaggggtcttgtgtgatgatgtggctcccccacatgcctttgctgtaacatattgtacccaaaccactgctacttggtacttctcggtatcattgtctcagtatggattctccgttgtcacagtgtttgaataattgaggcgtcagacttcagggttgctccaattcttggagatgtgtctgggtctgtgtctgtttgaagatggtctgaaactttgtgatggcgaagatgctgtgttattgtagtctgaatctgtaagtttgggaccaacattctgttattgcagttgacgcatggcttgtattttaggtagcatctgtctgtgctctggtgataaggtgttcgttctgaatatttgagtcaattaaaaaaatcttcggctaagttactactggaacacagaaagtttaggggtttttttttgcaatattttcaatacacagaaagtttagct

SEQ ID NO: 775 - DNA, 1068 bp, Sorghum bicolor
agggcggcgggctgccggaaggggaacatgctccctcctcatctcacagtatgaactgaaaaacaagaataaagaatttccatgcgatgagacagaatggcacggtaatgattcaatttggtcatcaaatgcctgattacgactccccagctacccaatcaaccagtgagagccatcaagaagtgtctggaatgagcgaaggaagcctcaacgagcataatgaccattcaggtaatcttgatggttactcaaagagtgacgaaaacaagatgatgtcagctttatccctgggcaatccagaaacagcttatgcacatccaaagcctgaccgtactcagtcctttgctatatcatacccatatgctgatccatactatggtggtgcagtggcagcttatggctctcatgctattatgcaccctcagctggtgggcatggtttcatcctctcgagtgccattaccaattgagccggccgtacctgcacgagtctcggcatcagcacgcgatgaagagagctcggggaacaggcgggcggttcctgaacacaaagcagcagccagagtcccccggcagcggaagcggcggcggctcctcggacgcgcaacgcatgcccatgaacggtggtggcctgttcacgaagcacgagcacagcttgcctcccggcgatcgccaccactatcacgcgagaggagggggcggcgcgtagggagccagcccccccaactggcaactcatccttggcttatcagcgatttccactcggctcttgtctaaactgaactgaactcggggtttctgtctctgcaactgtaactaaactaggtgtgtccgaattggcgggtcgctctgttgtactagtacctgggacgcgcactagagagtggaggtgatgcgggtgcggaaagaatgctgttctttggtgacgtaagctggacttacgttgtgtgtgtgtgtgtgtgtgagtgtgactagggcgaaactgccaaactggcgcctgtttcatgtaacctttgctccaggacgatgtctggtataataagtagcagtaataaccattttctctgtc

SEQ ID NO: 776 - DNA, 747 bp, Sorghum bicolor
ctccaagttcagagatccagcactcagacctgggcaacccgagcagcgtctccagcctgtcgggttcggaggtgtcaagcacgtacgatcgcgaagacatggatcactaccacagctttgatcacctccgcacgcccttcttcaccccgctcacgagcatcatggacggcgatcatggggtcgtcggtaaccccttcaagtgggcagcagcctctgaagtctgctgcgacctcctgaaagcatgactagcggggttgccggacagccaaatgctaggagctggtgactgctggcagttcccagctccagggtccgggattgcccctcccatcgtttggctcccggtaggcaaatcattcttggctgaaggcattgttgagcgttccactcatgccgcctagttctcctagaaactctgaaacctagtttctgggatcctgtggtgagtggaacattcctttgcctcaaaaaacaaaacaaaaaaaaagttggttgtactatcgaccaacttctaaatggtttcaccttattagctttcagaataataaagcctgatacttcggactcgtctgaagtttcagaggtactggaattgtgctatgtgtgagtctgttaaagcgtcaagaactacggatttgttggtgatgaattgtagtgtgcttgaagcttatgtggacttgattcgtacttttgtggtgtgctgaaaacttaaactcggtaatgtaatgaaactcgggcttggtttgt

SEQ ID NO: 777 - DNA, 438 bp, Sorghum bicolor
gcacgagggcctcctccaccagtaccagcaccagccgacccccgccacaaccttcttcatgcccatcccctccttccccaaccacaatcagcagtcgccactcgttcaaccaccgcccaaacgtcatcaatccataggggatgacctctatctcgcccgaaatcggcttctgtctccgccggcggggcaaggtcacgcctttccaccactaaatggtcctgctccgttccagctccagccttcgccaccaccgccccacggggcgatgaagacgacggctgcggaggcagcgcagcagcagttgctggacgagcttgcggcggcggcaaaggccgctgaagccggcaattccattggcgcgcgagagatattggcgcggctcaatcaccagcttcccccgctcgggaagccgttcctccgctccgcctcctacctcaa

SEQ ID NO: 778 - DNA, 1104 bp, Sorghum bicolor
gcacgaggatatcttgggctattcgacagcgaagtagaggctgcaagggcttacgataaggccgcaatcaaatgcaatggtagagaggccgtgacgaatttcgagccaagcacatatgatggggagctgctgactgaagttagcactgaagttgctgaagttgatctgaacttgagcatatctcaaccggcatctcagagccccaaaagagataagagctgcctaggcctgcagctccaccatggatcatttgagggctccgaatcgaaaaaaacaaagattgatactccctctgagctgtcgggccaccctcatcggttccctcttatgactgagcatccaccggcctggcctgctcaatctcaccccttcttcacaaatcatgagagtacatcatcgagagaccttaacaggaggcctgaggggggtgctcctagctgggcatggaaggtgacagcagctcctcctcacaccctgccattgccgctgttctcttcgtcatcgtcatccgctgcagcatcatcaggattctccaataccgccacgacagctgccccatcggcctccctccggttcgatgcaccgccatcgtcgtcatcgagccatcatcatcgccgctgagaatcaagaagccacactgtaaatctgctgggaagctggcatttttcccccctctgggcgttgcaactttttcggttttgcgccggctggggtggtttcttgtagtggatcgattggattcttcataactgtatttgcacactgtcatactgcccaagtgaaaatgctcctctctttacactacacagtacacacactgctgctcttggagctactgttgctgctagagattgactaacttaagcatctgagatactttgattgatctatatatacattgtgtagagaatatatcattgctgaaactattgacagaagtatatacaggtttgttccaggtcactcaccactagcttggtaatttgtaatctctgctacaagggttcttttatagctacgtcatgtaattctcttaatcttaatgaaacatgggctatattcccccatcgcggaaaattaacagaagtattatatacagttttc

SEQ ID NO: 779 - DNA, 935 bp, Sorghum bicolor
attggaaagtatgcaaaataccttgagatgctttctatagcatttgctggagatagtgataagggtatgatggacgtgatgaacggatgtaagaatctgaggaagcttgagattagagacagtccatttggtgatgttgcactcttgggaaatgttgccaagtatgagacaatgcgatccctttggatgtcatcatgtgatgtcacattaaaggggtgccaagtccttgcatcgaagatgccgatgctcaatgtggagatcatgaatgaactagatggaagtagtgaaatggaggagaaccacacagacatctctaaagtggataagttacatgttagtgaaatggaggagaaccacacagacctctctaaagtggataagttatatgtttaccgcacaactgctggagcgagggatgatgcaccaaattttgttaaaatcttatagagctagctgcgactaccctggtatcttcccaccctaagatggtcggtggaatccggcatgcctgggaccggggcaacagtggtaagttcttgaatcgtctccccctttgcagggtcaggaaaagccccactggtgtgtgcccttatcttggagcaacatggctggatccatcatcatcctctgtaccaccgcccactctttcagtgtctggtcatatggccacccaggccctttatccccctgtgcattctcactcgagaggagaggacagaaccagatgactttttctccttttttctcgccatgtaatctgtagtgtacctgtctccatttgcttgacattggcacggtggcttgtgttgctcccgctgctgttgtagtgttttgtttcgcaaacctgagaattattatcgggacattccggggacgatgatttgtttcttgctcctgtgaatgcattgcgtggaataatttgaggtttatctgcg

SEQ ID NO: 780 - DNA, 612 bp, Sorghum bicolor
cgtccggcccaatgctggagtcagtcctctacttctgcagacggatgaccaatgaggcccttattaccattgcaaagaaccggcccaactttacttgcttccgcctatgcatcattgagcctcacactccagactacactacacaccagcctcttgatgcaggttttagtgccattgtggaatcatgcaagggccttaggcggctttctgtttcaggccttctcacagatagtgtatttaaatccatcggggctcatgctgatcgtcttgagatgctctcgattgcctttgctgggaacagtgatttgggcctgcattacatcctatcaggctgcaagagcttgaagaagctagagatcagggactgcccatttggtgataagcccttgctggcaaatgctgccaagctggagacaatgcgatccctttggatgtcgacgtgctcactgaccctgggcgcatgccgacagcttgcacgcaagatgccccgccttagtgtggaggtcatgaatgatcctcgacggggatgccccttggactctttcacagatgagagccctgtcgagacattgtatgtctaccggacaattgcaggtccaaggtctgacacac

SEQ ID NO: 781 - DNA, 1855 bp, Sorghum bicolor
gcacgaggcgaggggaacccccgacccgacccgacccggaacagcagcaggaggagaggaggagcgcgagggagagagagagagagacacagaggggcgctgcgaggaggaggccggcggcggcgcgcgctcgcggcgccggcggcccggcgatgggggaggtggccgcgctgcgccagctcgtcggccaggtccaggagctctgggacctctacggcgccaacgcccaccccatccccaggtggtatttacttgacttcgaacatggttcaatcaaggatgattattgtgggggaaggcctggatacaactcagaattactgaagatcatggaaactaaccaatctccccctcgcaaacgaccgcggagagatcgaaaccgtgaaaaggcaccctcaaacaaaactgaagtaatgcaacaagagatctggagagatttccccgaagatctttttgaaactgtcattgcaaggcttccagttgctgcaatctttcgattccgcaccgtctgccgaaagtggtcttctcttttggggctcagacagtttttctcatcagtactctgaagctccacgtggactgccatggttctatacaatcacccatgagaatgcaaacaacaatgttgcaatgtatgatccttcgctgaagaaatggcaccacccatccgttcctctcactccctcgaagatagttattccagcggcatccgtgggtggtcttgtatgtttattggatctgagccacaggaatttctacatttgcaaccctcttatgcaatcactcaaggagatcccaccaagatcagttcagggatggtcaagagtcgctgtaggggatggtgttgaacggaagaagttctagtgatggctacaaagtaatgtggttaggaaatgatgggacttatgaagtctatgactctacaaagaacatgtggtcttgccctggatcttttcctccgggcatcaaacttccacttgctctaaatttcaggtcacagcctgtggcggttggcagcacggtatacttcatgtgcgcagaaccagatggtgttttgtcatatgatgtaagcaccgggatttggaggcaatttgccatcccactgccactgcatctgactgaccacacacttgccgagttccagggaagggttatgctagtgggtctgctgtgcaaaaatgcagcgacctgcgtctgcatatgggagttgcagaagatgactctcctctggaaggaggtggacagaatgccaaatatctggtgcttagagttctacggtaagcacatgaagatgacatgcctgggcaacagtggtttgctcatgctctccttgaaggcgaagcgtatgaaccgccttgttacttacaaccttttcaaaagggagtggcagaaggttcctgattgcatgctaccatgcagccgcaaaaagcaatggatagcatgtggcacagcgtttgatccggtcccctgtgccttggcctgacatggagtgtaccttctttggccgagcatgctaatattttagtcatttcatataattggtctattatctttagatatttctatgttgttgtgacaagttctgcaaaaccgcatcactgtggtttgttttgtatcacgctgaagcaatcaaactgtttccttctattacctgctgctacttgggtcagtgctacatcaattgggcaagccgacctgaatatgtttcatggaagtcaaaaatggaacgccaggtatctgtatggtcttggttttggtatgttttgtctgtgtcccgtttaagcttgtaatctttctgaacttgcagttacctgcccagaactgagtttattatacaataaaaagaacggcatgt

SEQ ID NO: 782 - DNA, 1863 bp, Sorghum bicolor
gcaccacggggggacgaggcgcgccaccggccgagccgaatcgagcagcagcagcagcagcagcgccctcccaccttgccatggcgacgcaggctgctttcctcgcggggttatcgcagctcgccgcacagccgggccgggaccgcgccgtggcgccggcgcgggtggccgtggcggcggtgggtgtgggtagcgccaaggtgggtgtgcgggtgggcgtgaaggcggggaccgccgaggccaaagcggtggcgcagcgccgcggggtgcggtgccgggccagcctgatcgagcccgacggcgggcggctggtggacctggtggcgcccgaggagggcgggcggcgcgcggcgctgcggcgggaggcggccgagctgccgcaccgcctgcgcctcagccgcgtcgacaaggaatgggtccacgtcctcagcgaagggtgggcgagcccgctgcaagggttcatgcgcgagcatgagttcctccaagcacttcatttcaatgccatccgcggcgcggatggcaggatggtcaacatgtccgtccccatcgtgctctcccttggggacgcacagcggagggccatccaggccgacggcgccacgcgcgtcgcgctcgtcgaccaacgcgaccgccccatcgccgtcctcagcgacatcgagatctataagcataataaggaagaaagaatagcaaggacatgggggacaaccgcgccgggattaccttatgtcgaggaggcaattaccaatgctggtgactggttgattggtggggacttggaggttatagaaccaatcaagtacaatgatggtctagatcagtatcgcctgtctccagcacagctgcgtgaagagtttgccaggcgcaatgctgatgcggtatttgcctttcagcttcgcaatcctgtacacaatgggcatgctctgcttatgaccgacacacgtaaacgcctccttgagatgggttataaaaatcctgttcttctgctccatccactgggaggattcacaaaagcagatgatgtgcctcttagttggagaatgaagcaacatgagaaggttcttgaggaaggtgtcctcaacccagaatcaactgttgttgcgatctttccctctccaatgcattatgctgggccaaccgaggttcagtggcatgctaaggctcgtattaatgctggcgcaaatttctatattgttggaagggatcctgctggtatgagccatcccacagagaaaagggacctctatgatgcggatcatggaaagaaggttttgagcatggctcctggtcttgagaggctcaacatccttccattcaaggtggctgcatatgacacaaagcaaaagaaaatggatttctttgatccatcaaggaaagatgatttcctcttcatctctggcacaaagatgcgcactcttgccaagaaccgcgagaatcccccagatggttttatgtgcccgggtggctggaaagtactcgttgaatactatgacagcttggtgccatctgagggcagcagcaagctgcgagaaccagttgcagcctaaaatctgggaagtgcttcagataaggaatcctattatatcagcgcaagcggttctttgcgacatagaaccgatgttatatgattgtataccggctgtaagacttaaaaacactgggcttggttcggacgttaatgtgtgcttttgtgactggtgtgccctatctgctggcagtgctgcacatgcagtagagcacatcaaatgtttggtgttaataaggacaggctatgtatcgtctgccagattgtacatatacattgtggtgatataattaaaaccctgtcttctgccgttcaggctccgtaaaaaaaaaaaaaaa

SEQ ID NO: 783 - DNA, 982 bp, Sorghum bicolor
gcacgaggtgagcatttcctctccctctccggggcggggctcatccatgcacgggggcgggatgggtgtcttcttcctctaaccggccggcctcttgccaagagaatcatatcgccgtccatgcatatatgtgatatccgtctcccagggccggtgatgtttacacgagaggaggaattctagcctgcctcttcctctgatcgttgtcagcaagattctccgtccaaccgccagaaccaaaatcccttttaaagcaggggagctcccagctcccgagtttccccaaacacttcatttcagccttcagctatggaggcatcatcggcatcagcggtcgagtcgaccgccaccgtgtccgtcttcgatgtatcatccaacaagcagcgcccagacacggcgaagctcgtgctgaacagccccagcccgccgagcctgcgcgaggagctcgtcggcgtggtcggcaaggcgttccggccacggccccccggcggcggtggccgggcgccgcgctgcccgtggatcctcacggcgctgcagtgcgtgttcccggtcctgcagtgggggaggacctacaccctcaagtccttcaggagtgacgtcatggccggcctcactcttgccagccttggcatccctcagagcattggatacgccaacctagccaaactggaccctcagtacggtctttacacaagtgtcgtgccaccgctgatctacgctgtcatggggacatcgagggagatcgccatcggcccagtcgccgtcgtctcgctgctgctgtcgtcgatgatccagaaggtcgtcgacccggccgccgacccggcaacctacaggtcgctcgtcttcacggtgactttcctcgccggcgtcttccaggtctccttcggcctcttcaggctggggtttctcgtggatttcctgtcgcacgctgccatcgtggggttcatgggcggggcggccatcgtgatcggactgcagcagc

SEQ ID NO: 784 - DNA, 1408 bp, Sorghum bicolor
actcctctcgctagtcgctactgcctccgtctctccaccctacagcctcgtcccggcacatcaactcgcttacgctaccaccgccagcacacacccaggccgcagcgccgcgctccgttcacctcctcttacgcgcggtgccctaccggcgcgcggtgtctggctagaatcttggtggtcgttcgcaggggtagccaagctatctagctagctcggaaagcggccggccgcgcgcggagatgatgatgatgagcggtcgagcgggcggcggcgccaccgcggggcggtacccgttcacggcgtcgcagtggcaggagctggagcaccaggcgctcatctacaagtgcctggcgtctggcaagcccatcccgtcctacctcatgccgccgctccgccgcatcctcgactccgccctcgccacgtcgccgtccctcgccttcccgccgcaaccctcggtggggtggggctgtttcgggatgggcttcagcaggaagcccgacgaggacccggagcccggccggtgccggcggacggacggcaagaagtggcgctgctccaaggaggcgtacccggactccaagtactgcgagaagcacatgcaccggggcaagaaccgttcaagaaagcctgtggaaatgtccttggccacaccggcgccggcctctgcggtgtcctccgccacaagcgccacagccgccgccgccgccgccaccaccaccacctcgtcgccagcaccgtcctaccgcccagcgcccacctcgcacgacgcctcgccgtaccacgcgctgtacggcggcggcagtccgtactcggcgtcggcgcgtcccgccggtggccccggcccgtaccatcatcccgcgcaggtgagccccttccacctccacctcgagaccacccacccgcacccgccgccgtcctactactccgtagaccagcgggactacgcgtacgggcacgccaccaaggaggtcgtcggcgagcacgccttcttctccgatggcgcggccgagcgggaccgccagcatgccgccggccagtggcagacaaaatggtgggtctggacaaggttctggctctggctctggatatggtcaggctggcggatatgctcaggcaggtggccaaggtggtggtggcggaggcggccaaagtggtcaaaatggtagtggatatggaagtggctcagggagtggctctggaagtgctggcagtggtaatccgtaggccttctatatggatttggatatctaatatacacctttactaatattgagtacttcggtaatgaagaataaaagggctttatgtgcccttgtattaaaattagttgtgtggcatataaaatgtgttactatcaataatacaagtgtccttgtcttcttgtgtgtaaaaaaaaaaaaaaaaaaag

SEQ ID NO: 785 - DNA, 715 bp, Sorghum bicolor
atatggatcgagctgaagagctggtccgtgaaatggaagaggatggcattgatgctcctatcgatgtttatcacagtatgatgcatggatatactgttgcccaagatgaaaagaaatgtctaattgtgtttgaaaggctgaaggagtgtggcttcagaccatctataatatcttatggttgccttattaatctgtatgttaagattgggaaggttccaaaagccttagctgttagcaaagagatggaatcacatggcatcaaacataataacaaaacttactctatgctgatcaatggatttatccatctgcatgactttgcaaatgcttttagcatttttgaggacatgataaaatcaggtttgcagcctgatcgtgccatatacaatttgctggtagaagcattttgtaagatgggaaatatggatcgagctattcgcatattcgaaagaatgaagaaggaacgaatgcaaccatcaaatagaacattcaggcctatcatagaaggatttgcagttgctggagatatgaaaagggctctcgatacccttgacctaatgcggcgaagtggttgtgctcctactgtaatgacttataatgctctcatccatgggctaattaggaagcaccaggttgaaagagctgtttctgtacttgacaagatgtctattgctggcattgcaccaaacgagcatacatacacaatcattatgag

SEQ ID NO: 786 - DNA, 860 bp, Sorghum bicolor
tagtgcttatcctgttggtattcttctatacctcccgtgctctcgtccctcccattgtacctgcagtgcagcccatcatactttagatcatcatggccaacgccttgctgctcctcgtggcgctgctcgtcgccgggtgcgcggctctggcttcggccacgtcgtacaccgtcggcgacgggcagggctggacgaccaacgtcgactacagcacctgggccagcggcaagagcttcgccgtcggagacaaactagtgttcaactacatgagcaaggcgcactcggtgacggaggtgagcaagagcggctacgacacctgctccggcgccaacccgctgagcgacgacgagagcggctccaccgtcgtcccgctccagaccccgggaacgcactacttcatctgcaacgtccccggccactgcgcggaaggcatgaagctggccgtcgccgtctccgccacgccgtcttccgcggggggcgccctgctgcaggtcccggcgatggcctccgtcgtcgccgcggcggccgcaggcgctgcgatcaagctcgcgctcttctgacggagcacggcggcgcggctatggatcgtcagagtcgtctcagggtagagacagtgcatgcagttggctatgttcttggacgttgatggttcgtgtaatcggtgattactgtccacacttaatttctgctacgttttctggctattgttctcgtcgtgcagctcatgtatgtatgttactctgcggtggcgagtgccttttctgatgcctctgtcgttgtgtgttcatcacacggtgtatatcgtcgtgtgtgattgttctttgggatatctctgtgtcaataaaattgcctcattctct

SEQ ID NO: 787 - DNA, 676 bp, Sorghum bicolor
  misc_feature (670)..(670): n is a, c, g, or t
gcacgaggcaccatcactagctactcttctcttgtcgcttgctctctctctatatatataccagaagcaccagaagttgctgctctctgtgtgccggccggtcgtcgtcgtcgtctgagcatccagctggtgaggtgaggtgaggtgaggtgagtagacagcaatggcggcgcagcagcagcagggaagaggcagtggagctgcggtggtcgttgcggcggcggtgctcctctgcgtgctcctccaagcccacgtcgcggagtcggccgtgttcaccgtcggcgaccgtggcggctggagcttcaacaccaacacctggaccaacggcaagcgcttcaaggctggggacgtcctagtgttcaagtacgactcgacggcgcacaacgtggtggcggtgaacgccgccggctacaaaggctgctccgcgccccgcggcgccaaggtgtacaagtccggcaacgaccgcgtcacgctcgcccgcggcaccaactacttcatctgcagcatccccggccactgccagtccggcatgaagatcgccgtcaccgccgcctgactgatcgacgacaccgccgccgcgtgatatacatatatatacatctatctatcgactagctgattgtcagttcgagtgactcatatggacttttgttattaccatcgttgtttncatgga

SEQ ID NO: 788 - DNA, 706 bp, Sorghum bicolor
tactggatcgccaactcggaaaccttcagaggaaagccactgctagcaaatccccccgcggttccatcgagagccaacgccgccgcggcaacatttcgttctcgccatggcgtcgctgtcgtcgacctggctgctccttctcctctcctgcctcgcgcttgcgctgctcgcggcggacgccgaagtgcaccaccatgagttcgttgtccaagagacgccggtgaagaggctgtgcaagacacacaacatcatcacggtgaacggacagtttccggggccgatgctggaggtcagggagggcgacacgctcgtgatcaacgtcgtcaaccgggcgcagtacaatgtcaccatccactggcacggcatccggcagatgaggactgggtgggcggacgggcctgagttcgtgacgcagtgccccatcaagcccggcggcagctacaagtaccggttcaccatcgaggggcaggagggcacgctgtggtggcacgcgcacagctcctggctcagggccaccgtctacggcgggctcatcatccgccccagggagaacaagacctaccctttcgccaagccctcccgcgaagtccccctcatcctcggggaagtggtgggatgcgaacccgatcgatgtcatccgggaggctcagaagacgggcggcggtcccaacgtctccgacgccttcaccatcaacggccagcccgg

SEQ ID NO: 789 - DNA, 643 bp, Sorghum bicolor
gcacgagggcctctagcgctaggctacctagcttcccgtctcttccccatcagatcaatcgtcctcgccggctatctcaacttcgtcttgcttcttcctgtgctcctttttgttcctggacggctaataactagatctgagaggcagaaaaaagagggatggggagggggaagatagtgataaggaggatcgacaactcgacgagcaggcaggtgaccttctctaagagacggaacgggctgctgaagaaggcaaaggagctctcaatcctctgcgatgcggaggttggcctcatcatcttctccagcaccggaaggctctacgagttctccagcaccaacatgaaagctgtgatagaccgatacggaaaggcaaaagaggagcagattggcaccaacaatgcaacttcagaactcatgctctggcaaagggaggcagcaagcttgaggcaacaactgcacaacttgcaagagagccacaagcatcgtctgcgagtggttctgaaaaaaaaaggatcactcatcaataggaagtttcaatgacacatgaaaaacttcatagaacataaaaaagtgaaacgtttcaaccaaggattaagtaaatatatagttattgaagacattaacaacattcattatttcag

SEQ ID NO: 790 - DNA, 794 bp, Sorghum bicolor
ccagatccgcgctctcccactccagtgtccagtccattccctccctccctccctcccgcacccaccaatctctagagctttaccactacggcctacggggctccggcggttcagcctacaggagaccagcaaggcagcaattgcgacgtccccgcgcaggttcatccaagaactgaactaatggcagaagcactgctatctgctctctcgaaaattggtaccgttttaggagatgaagtcatcaaattcgtcattgctgaagcatctaaaaaggcaactaatcttagggagctaccaaaaaatataaggcacattgagagagaattgaatatgatgagaaatgtcatacgagatttggataccacaaatctcagcatcaatgtggtcaagggttggatcggggagctgagaaaggtggccttccatgtggaagatgtaatggacaaatactcatataacgcttttaagctgcaggaagaaggatcgctgatgtggttcatcaaaggagcacataatgccaaaattttcagtgatattgctgatgaggtggttcgtataaagggtgagattgagcaagtaaaacaactgcagaagaactatttccctgctctccaagttccagcaggccctgtaattgttcgacatggatcccaaaccttcttgccagagcttattcaagatgaagatctcgtggggattgcactgaatcaagcaaagctgattggatggcttcatagcaatgaaccaaacaacacagtgataacggtgtcgggtatgggtggattgggaaaaac

SEQ ID NO: 791 - DNA, 1606 bp, Sorghum bicolor
tgacgccgccatggccgccgccgttcgccacatcgtgcgacgccgtcatgtcccggctgccaccaccacaccggtccccactccgggctccatcctcaacccgtcctcgccgagcactcccctcacctcgcgagagaagacccgactcgccatctctctcctcaagtcttccccgccgcctccccccgaccagatcctctccatctgccgcgccgccgcgctgaccccggagacccacatcgaccgcatcgcgctgtctctagccgcatcagagctctcctccgctccggacaccctccgtgacctcgcctctaccgtcctcaccccgcgccacgcgccccacgccatcgtgctcttcggccaggcaaacctcctccccgacgccatctccactttccagtcctccccctccacccgctcccgcaacgccctcatctttgcgtgcatcgtctccggtaaccacacggaggccgcccgcgtcttccagacattcccagacgcccatggcgtcaaacccaacaccgagaccttcaatgccatcatcaaatcagtcgccgagtctggcaccataaggtccttttactcggtttttgatgaaatgtgcaagaagggcttgaagcccaacgccaccacgtttaccactgctctggctggtttctacaaggaggagaggtttgatgacgtcgggaaggtattagagctcatgaagaagaatggatgtggtgagtccctgccggtatacaatgtgagggtgcagagtttgtgcaaactcggtcggagtggtgaggcgagggcattagtggacgagatggtgaagaagggcacaaagccaagctgggtgacctacaatcatctgatttatggattctgtaaggagggggatttggaggaagcaaaacgtctgtacaaggagatgggaaggaaggggcttgttggagatatcaatttctattttatgcttattcattacctttgtaagggtgatgattttgacactgcccttggagtatacaatgagatagcagctaagaattgggtgccatgcttctcgaccatgaaaatgcttgtgaatggacttgctgggagctcaaggatcgatgaggcaaaggggatcattgagaagatgaaggagaagttcccagataaaactgaggggtggaaggaggtggaggaggcattgcctcattagagtaaaacatcgatgatctctcagaaaatttgccagtgctgaaggcattgttgattgggagttgggactgcatctatatttgatcaactgtttcaagcatatgaagctatggcctggattcaattttatatagatgtgaagcatgctccagctgtgatgacggattgacagtggcagctgtaggttgttcttggcgatgctccagtagttaatacttttgcaaattacagttttagttctgggagttggagataataaaacttgttcgctttgctctgtctgttccgttttgcatgggctgagcctatcactgcctatacggactgttcgcctgcaatgtgtgcagtttgtaagtgatgcaatgtatgctgtaactgtttcagtttgaatggaatgaaactaatggttactccctgg

SEQ ID NO: 792 - DNA, 1288 bp, Sorghum bicolor
cgaccgccgggtcaacctctacgggatggcgcaggccgccatccgccgcgccaagggccagtgcgaggcattctgggccgagtacgcggccgatgatgatgtgctccatcttctcggcgatgaggcaccggccctaaagagtctccgcctcattgcttgtcaagacatcgttgaatttgaagaggagataaggaagtttcctctgcttgaggagctcgagatttcactcttcacaaatatagatgggaagcgtgtgtttgaggaggttggcaaagcatgcccggagctgaagcatttcagatttaacaagtaccgtttccacaactttggagatattgaatactctgaggatgatgatagcgagatcaagtacaacaaggatgacaatgccctggggattgcaagtatgcatgggctgcgctctctgcagctctttggcaatgacttcaccaatgaaggactgacagccatccttgacaattgcccccacctggagttcctcgacatccgtcactgcttcaacatccagatggacgatgccctacgggcaaaatgtgctgcaatcaagactctgaagcctccctatgattcaactgatgactataatttacagtttgagggaccaatctggtcaccttctgggcttggtattgactttgacaccgacagtgatggttgtgactacattctggactcagatgattatgatgattactgtgacccgatgcgctaccttgatggtgtctatgagtctgagcttggcccagaagatcggatgttcctcaagggtatgcgtatgctgatgagagatgatgacgatgatgattactgagtaattgtggtccttaccaccgcaacctttgatggcgtctatgtggattccttgaagatctgatgttctttgttggacctcacatgttcctgaaataaatgtgacatggggattgctggtgcttgggatctcaaacctccttgctgcaacattgcttggcaatggcaactttatcaccgatgtgtctcgtatttgtttcttttctgtgtgttcgttgagtaataataatgtgaacttatagagctgacagtagttttttcagtgcttcaccatgtttcttccacagttggaattggcaaaatgtctgcattactgtagatctgccatctgtggctgggcgaggaactggtgtccaacgatatatcatgtctacatttgctaccgttcgagaaacaatggtatattaaaaaagtacaaagcatggcatgaatcaaaaaaaaaaaaaaaaaaaaaagg

SEQ ID NO: 793 - DNA, 1390 bp, Sorghum bicolor
  misc_feature (1309)..(1309): n is a, c, g, or t
acatagtggcttcttctccctaaacctgaaactatcaggcctgttgttcttcctatcaggctggagttcatcaaggatctaaactttgaaactggagccgacaagcacacagaggaagaagaacaccaagactggttcccaacccatccaaggtagaagcgagcaacgttagtgtggtagtaacatggtgactgtgagagaggagatgcgtaaagggccatggacagagcaggaggacatgcaactggtatgcactgtccgcctctttggtgaccgtcgttgggacttcattgcccaagtctcaggtttgaggggttgggaaactacaacttaggtagctattttgctattcttagcgcaaagtcgcaaacataaatgtcttcctgtctaaccagccctcttcatactatacgttctctatgttcatgcaggcctcaacaggacaggaaggagctgccgcctgcggtgggtgaactaccttcatcctggcctcaagcatggccgcatgtcaccacaagaagaacgccttattattgagctccatgctcggtgggggaacaggtggtctaggatagcacggaggctgccagggcgtacagacaacgagatcaagaactactggagaacacacatgagaaagaaagcacaggagaggaagatgagcatgtcatcaccttcatcctcatgctcctcactgacataccaagcctgccatcttgacactgttccagtcattgggatgagcagtggtgacactcacaatggtggctgcgtcaccagcgccctcgagaacacacagagtgtcatgggtggataccccatggaccagatatggaaggagattgaggcacctcaggcacctgccttgctgggtattgctgaagggaaagagaagacatgcagcagtatcccctgtcatctaccatcatctgctatgtgggactacaaatatcctgaggtattctggaagatggaagatcaagaaatcatgatgtgatagaagatgaagaaaccttgatgttggcttatttggttatggtaaataaggccctcactattgaaagctgaaggaatacatctatattggtcaggccactcggctatctgcctagcagatttgcagtacttgtacttcctagctatgcttgcattagtatgggtttcagtattttaaaatatacagtgatactggaggtatgcttatgatgtatgtatctattagtgtgcaaaatagtttgtatcagtttgtggaatagtgtgcaatacaaggacgctctatatgcatcatgtacttatttatctctgttgntattgcgccgaacaaatagcagcataatcttgtttgcagttattattcaatagaatatgaatttgatgccaaatgaatatt

SEQ ID NO: 794 - DNA, 354 bp, Sorghum bicolor
  misc_feature (154)..(154): n is a, c, g, or t
gcacgaggggacggcggaggaggaccagaagctcgtcagcttcatcctcggcaacggccagtgctgctggcgcgccgtgcccaagctcgccgggctgctgaggtgcgggaagagctgccggctccggtggaccaactacctgcggccggagccntcaagaggggcctgctctccgacgccgaggagaagctcgtcatcgacctgcatgctcagctcggcaacaggtggtccaagattgcgtcgcacttgccagggcgaacggacaacgagatcaagaaccactgggaacacccacatcaagaagaagctcaagaagatggggatcgacccgctcacccacaagcccctctgccc

SEQ ID NO: 795 - DNA, 2132 bp, Triticum aestivum
  misc_feature (1928)..(1928): n is a, c, g, or t
  misc_feature (1951)..(1952): n is a, c, g, or t
  misc_feature (1959)..(1959): n is a, c, g, or t
  misc_feature (1966)..(1966): n is a, c, g, or t
  misc_feature (1968)..(1969): n is a, c, g, or t
  misc_feature (1976)..(1976): n is a, c, g, or t
  misc_feature (1985)..(1985): n is a, c, g, or t
  misc_feature (1991)..(1991): n is a, c, g, or t
  misc_feature (1997)..(1997): n is a, c, g, or t
  misc_feature (2001)..(2001): n is a, c, g, or t
  misc_feature (2029)..(2029): n is a, c, g, or t
  misc_feature (2038)..(2038): n is a, c, g, or t
  misc_feature (2042)..(2042): n is a, c, g, or t
  misc_feature (2044)..(2045): n is a, c, g, or t
  misc_feature (2050)..(2051): n is a, c, g, or t
  misc_feature (2077)..(2078): n is a, c, g, or t
  misc_feature (2084)..(2084): n is a, c, g, or t
  misc_feature (2090)..(2090): n is a, c, g, or t
  misc_feature (2122)..(2122): n is a, c, g, or t
cgtccgcggacgcgtgggccctcccctctctctcctccctcaaaactctctctccctccctgaaaattctccgcatactgggtgcccaagtggtgccggcatctcgctgaggcgagagagagagagagagagagagagagatcctcccctgtttccactcccccgccgctcccccgacccgccctctccagccccgccgccgagccgggaggaggagttgttgcagctcagctccgccccagctcagtccccgaccccgagctgatcgtcccgccggcggcgagattcgaccagggcacgacggagagatgtaccgggtgaagagcgagagcgactgcgagatgatgcatcaggaggaccagatggactcgccggtgggcgacgacggcagcagcggagggtcgccccacaggggcggcgggccgcctctgaagaagggcccctggacgtcggcggaggacgccatcctggtggactacgtgaagaagcacggcgaggggaactggaacgcggtgcagaagaacaccgggttgttccggtgcggcaagagctgccgcctccggtgggcgaaccacctcaggcccaacctcaagaagggggccttcacccccgaggaggagaggctcatcatccagctccactccaagatgggcaacaagtgggctcggatggccgctcatttgccagggcgtactgacaatgaaataaagaattactggaacactcgaataaagagatgtcagcgagctggcttgccaatatatcctgctagcgtatgcaaccaatcttcaaatgaagatcagcagggctccagcgatttcaactgcggcgagaatctttccagtgaccttctgaatggaaatggtctttatctgccagattttacctgtgacaatttcattgctaattcagaggctctatcttatgcaccacagctttcagctgtttcaataagcagtttgcttggtcagagctttgcatccaaaaactgcggcttcatggatcaagtaaaccaagcagggatgctaaaacagtctgaccctttactccctggattgagcgacaccatcaatggcgcgctctcctcggtcgatcagttctcaaatgactctgagaatctcaagaaggctctgggttttgactatctccatgaagccaactctagcagcaagatgattgcaccatttgggggtacacttactggcagccatgcctttttaaatggcaccttctctacttctaggaccatcaatggccctttgaagatggagctcccttcactccaagataccgaatctgatccgaatagctggctcaagtataccgtggctcctgcgatgcagcctacggagttggttgatccctaccttcagtctccgacagcaactccgtcagtgaagtcggagtgtgtgtcgccaaggaacagcggtctcttggaagagctgcttcatgaagctcagggactaaaatctgggaagaatcagcagctttccgtgagaagttcaagttcctctgtcagtacgccgtgtgatactacggtggttagcccagagtttgatatctgtcaggactattgggaagaacctctgaatgaatatgctcctttcagtggcaattcactcactggatctacggctcctgttagcgctgcgccgcctgatgtttttcagctctccaaaattcctcctgcacaaagcccttcgctgggatctggtgagcaggcaatggagcctgcatatgagcctggggctggggacacttcgtctcatcctgaaaacttcaggccagacgcactcttctccgggaacacaactgactcgtccgtcttcaacaacgccaataaccaatgctcctgggcaacgacattgaagacgggactgcaagcctgttttcggcgacgggattcgtgtttgatacttccccgtggngcaacatgccacatgcttgcctnntgtcggnggaattnanntgaattncttgccganccttgngcggtntcgntggggattcttggttttcctcaccctgnttgttttgnggtngnnttttnngaaagccttattgattgttttcctgnntgcttnttgttnctggtccttgttggcttttgcggttgtttccngttgtgcttt

SEQ ID NO: 796 - DNA, 1245 bp, Triticum aestivum
agccaaagccaaagccaagcagagagagaaacggaaacagagggggagaagacttgcagaggagaggagcaagttgcggaggaggcagcggcaagggaggaggggtcgccggaagggggacatgctccctcctcatctcacatctcgcagcttgaactgagagcaagagtagaaacccataagatgagacgcaagcaaaatatgcatgaaaatggcacaatcatgattcagtttggtcagcaagtgcctaactgcgagtcctcagctagcgattctcctcaagaagtgtccgggatgagtgaaggaagctttaatgagcagaatgatcaatctggtaatcgcgatggctacaccaagagtgatgaaggcaagatgatgtcggctttgtctctgggcaattcagaaacagcatacacacccccaaaacctgaccgcactcatcccttcgccatatcatacccatatgctgatccttactatggtggtgcagtggcagcctatggcacacatgctattatgcacccccagatggtgggtatggtaccatcctctcgagtgccactgccaattgaaccggctgccgccgaagagcccatttatgtgaacgcgaagcaataccatgccattctccgaaggagacagctccgcgcaaaattagaggctgaaaataagctggtcaaaagccgtaagccgtacctccacgagtcccggcaccagcacgcgatgaagcgggctcgggggacaggcgggcggttcctcaacgcaaaggagaagtccgaggcggcctccggcggcggcaatgcatcagcaagatctggccacgccggcgttcctacagacggtggtggcatgttctcgaagcacgaccacaccttaccgtccggtgacttccattaccgcgcaagagggggcgcctagggcgggcctttgcccccggcaaatcatccttggcttatgtgtgtggcgaatgaccgtcaattcggtccaatgatattgtaaaactgaatttagagtctgcaattgttacttgggggtttggtagacggtcgttgtgtttggggacgctgcagctgcagctgcagctgccggttctcttgttgtggtaggtttgtgtggcatggcaggtgctgctaagctggagcctgcttgaactgttttcctgtcactttgttggggtaataatgaccatcctgtatgatattagtactgacttggagtaataaccattcccggcgtgatgcattt

SEQ ID NO: 797 - DNA, 1460 bp, Triticum aestivum
ccctgcgtgccccgccgcggaatccgggggtcgccccacgcgtgcgccctctcgtgcgtccacgcgtccgcccacgcgtccgcggacgcgtgggtgcctctgttcagccaaagccaaagccaagctgagagagaaacggaaacaaagacagagggagaggagacttgcagaggagaggagacgggaggagcaagttgcggaggaggcagcggcaagggaggaggggtcgccggaagggggacatgctccctcctcatctcacatctcgcagcttgaactgagagcaagagtagaagcccatgagatgagacgcaagcaaaatatgcatgaaaatggcacaatcatgattcagtttggtcagcaagtgcctaactgcgagtcctcagctagcgattctcctcaagaggtgtccggaatgagcgaaggaagctttaatgagcagaatgatcaatctggtaaccgcgatggctacacgaagagtgatgaaggcaagatgatgtcagctttgtctctgggcaattcagaaacagcatacacaccgccaaaacctgaccgcactcatccctttgccatatcatacccatatgctgatccttactatggtggtgcagtggcagcctatggcgcacatgctattatgcacccccagatggtgggcatggtaccatcctctcgagtgccgctgccaattgaaccggccgccgccgaagagcccatttatgtgaacgcgaagcaataccatgccattctccgaaggagacagctccgcgcaaaattagaggctgaaaataagctggtgaagagccgcaagccgtacctccacgagtcccggcaccagcacgcgatgaagcgggcccggggaacaggcgggcggttcctcaacgcgaaggagaagtccgaggcctccggcggcggcaatgcatcagcgagacctggctacgccggcgttcctgcagacggcggcatgttctcgaagcacgaccacaccttaccgtccggtgacttccattaccgcgcgagagggggcgcctagggcgggcctttgccccctggcaaatcatccttggcttatgtgtgtggtgaatgaccgtcaattcggtccaatgatattgtaaaactgaatttagagtctgcaattgttacttgggggtttggtagacggtcgttgtgtttggggaggggacgatgcagctgcagctgcagccggttctcttgttgtggtaggtttgtgtggcatggcaggtgctgctaagctggagcctgcttgaactgttttcctgtcactttgttgtttggggtaataatgaccatcttgtatgatattagtactgacttggagtaagtaataaccattcccggcgtgatgcatttgcgcccgtggtggtgtttctgttgaaaaaaaaaaaaaaaaaaaaaaaaaaaaaaacaaaaaaaaaaaaaaaaaaaaaaaaaaaaaaaaa

SEQ ID NO: 798 - DNA, 1996 bp, Triticum aestivum
cgctatgaccttaggcctatttaggtgacactacagaacaagtttgtacaaaaaagcaggctggtaccggtccggaattcccgggatatcgtcgacccacgcgtccgcgcgctcccatgccatagacgcgaccccactcatcggtccaggtcggtcgctcggagccgagcggcggcgggcgggcgaggagtgcgttttattcggtcccggcgggcctcggatcggagatggtgctggatctcaatgtggagtcgccggcggactcgggcacgtccagctcctccgtgctcaactccgcggacgccggtggcggcggcttccggttcggcctgctcgggagccctgatgatgacgactgctccggcgagccggcgccggtcgggcccgggttcgtcacgaggcagctcttccccgcgtcgccgcccgggcacgcgggcgcgcccggggtgacgatggggcagcaggccccggcgcctgcgccgatggcgcccgtgtggcagccgcggcgcgccgaggagctcctcgtggcgcagcggatggcgcccgcgaagaagacgcggcggggcccgaggtcgcgcagctcgcagtacaggggcgtcaccttctaccgcaggaccggccggtgggagtcgcacatctgggattgcgggaagcaggtctacttgggtggtttcgacactgcgcacgcggccgcaagggcctacgatcgcgcggcgatcaagttccgggggctggaggccgacatcaacttcaatctgagcgactacgaggaggatttgaagcagatgaggaactggaccaaggaggagttcgtgcacatcctccgccgccagagcacggggttcgccagggggagctccaagtaccgcggcgtcacgctccacaagtgcggccgctgggaggcaaggatgggccagctgctcggcaagaagtacatatatctgggcctctttgacagcgaagttgaagctgcaagggcgtacgacagggcggcgattcgcttcaatgggagggaagctgtgactaactttgagagcagctcctacaatggggatgctccacccgacgccgaaaatgaggcaattgttgatgctgatgctcttgacttggatctgcggatgtcgcaacccaccgcgcacgatcccaagagggacaacatcatcgccggccttcagttaacttttgattcccctgaatcgtcaaccacaatgatctcttctcagccaatgagctcatcttcgtcccagtggcctgtgcatcaacatggcacggcagtagcacctcagcagcaccagcgtttgtacccatctgcttgtcatggcttctacccgaacgtacaggtgcaggtgcaggagaggcccatggaggcaaggccccctgagcagccgtcgtccttccccggctgggggtggcaagcgcaagccatgccgccgggctcctcccactcgccgttgctttacgctgcagcatcatcaggattttctaccgccgccgccggcgcgaacctcgccccgccgccgccgtacccggaccaccaccggttctacttcccccgcccgccggacaactgaagctggccgttgtgaccagacggcggtgggtgcgcgcggtcgaggtgttcgctcctcgtcgtcggtaacgcttgttgtgaaactataatcggagagagatgacattgccaggccatgtgtggtgacactactggctggtctctcgccgcctcgccatgatcgggatcacgcggatcatggctgttcattagattctcatgtatccaatgttcaagtttcccaaacggttgaaaaaactttgaaatttgtgatggcaaaaaaaaaaaaaaaaaaaactcaaggggggccggacccattcccccttagagatcgaatacaatccttggcgtcgttacacgtcggatggaaactggcgtaccaactatcgcttgagaaatcctttccacttgctaaacaaaagccgagatcccttccacatgcaccta

SEQ ID NO: 799 - DNA, 2030 bp, Triticum aestivum
tagggcctatccaggtgacataatataacaagtttgtacaaaaaagcaggctggtaccgctcccccgggccccgcgggccggcggcccgcgccgccgaggcaaggcaagggcaaggcagcgagcatttaggcaggcagcgggagaaaagcagcgtgccgactgcccccgagccaacccccaccccacaaaaggagggaaggggggagagcgcgagacacagaggcggccgcgaccgagggcgccgccggcggcggcggtggcggcggatgggggaggtggcggcgctgcggcagctggtcggccaggtgcaggagctctgggacctctacggcgccgtccacgcccacgcccacggccccatccccaggtggtatttacttgactttgagcatggttcggtcaaggatgattattgtggagaaaggactgggtacaactcggaattattgaagatcatggaagctaaccaatctcctcctcgcaagcgaccacgcagagacagaaaccgagagaaagcatccttcctgaactcggctgaagcaatgaagctagatatttggagcgagttccctgaagacctttttgaaactgtcattgcaaggcttccagtggctgcaattttccgattccgctctgtttgccggaagtggtgttctctggtaggctcagacaatttctctcagcagtactctgaagtcccacagggaatgccatggttctatacaatcacacatgagaatggcaacaacaatgtagcgatgtatgacccttcgctaaacaagtggcaccacccttctgttccccttgctcctgcaaacatagtaatgccagtggcatctgcaggtggccttgtgtgcttattggatcttagccacaggaacttctacatatgcaaccctcttacacaatcactaaaggaaattcctccgaggtcagtccaggcatggtcaagagtgtcagtagggatggtgctgaatggaagaacttctaatgagggttacaaagtgatgtggttgcgaaatgatggaaatcatgaagtctacgactcagtgcagaatatgtggtctcagccaggcgcgtttcctccaagcatcaagctcccacttgctctaaatttcaggtcacagccagtcgcggttggcagcacgctgtacttcatgtgctcagaacccgagggtgttttgtcatatgatgtaagcactgggatttggattcatttcatcatcccgctgccgctgcatctgactgaccacacacttgccgagttccaggggaagatcatgcttgtgggcctgctgtgcaaaaacgcagcaacctgcgtctgcatctgggagttgcagaagatgactctcctctggaaggaggtggacagaatgccaaatatctggtgcttagaattctacggtaagcacatgaggatgacctgcctgggcaacagcggcttgctcatggctctccttgaaggcgaagcggatgaaccgcctcgtgatgtacaaccttgtgagcaaagagtggcagaaggttcctgactgcatgctcccttgcagccgcaagaagcagtggatagcatgtggcacggcattcggtccgtgcccctctgcctcgccctgacggttctcagcaaaggttgacattgtcgctttcattttgttacacatttccgtgtcgtcgcgacttggcgagaaggttatctgttatgttattgtacaaattcatgtcaaagtggttgttttcgttacttgctgaagcaatcggaccgttttgttactgtcggttttatcatccgcgagaatttgtgtcggtgcaatggcaactgatcagttgaactgaatctgttaaggttactgcgatcaaaaggctgaagagcagacatctgttactgtattagaacttttatttgttccgttgttgtgtcatgttcagtatgtaatatttgtactaaatctcgggtcgtctcctcagcaaaactgagcctactctataataataacaactggagttgtatttataaaaaaaaaaaaaaaaaccg

SEQ ID NO: 800 - DNA, 720 bp, Triticum aestivum
atggggcgcggcaagatagtgatccggcggatcgacaactccacgagccggcaggtgacgttctcgaagcggcggaacgggatcttcaagaaggccaaggagctgggtattctctgcgatgccgaggtcggtctcgtcatcttctccagcaccggccgcctctatgagtacgccagctccagcatgaagtcagtgatagatcgatatggacgagccaaggaggagcagcaacttgttgcaaaccccaactcggagcttaagttctggcaaagggaggcagcaagcttgagacaacaactgcacaacttgcaagaaaatcatcggcagttgatgggacaagatctttctggaatgggtgtcaaggaactacagactctagaaaatcaactggaaataagcctgcgttgcatccggacaaaaaaggaccaaatcttaattgatgagattcatgaactgaatcacaaggggagtcttgtccaccaagaaaacatggaattatacaaaaagattaacctaattcgtcaagaaaatgctgagttacacaaaaagctctctgagacggaggcagcgactgaagttaaccgagattcaagaaccccatacaattttgcagttgttgaagatgccaatgtttctgttaatcttgaactcaattccccgcagcaacaaaatgatgttcagcatactgcgccccctaaactaggattgcaactacatcca

SEQ ID NO: 801 - DNA, 402 bp, Triticum aestivum
tctaccttccccacataagaccagcccccatacacttcttcttcttcttcttcctcttcttcttcttctcagtccgcctgctagctcttagatctgagagggatggggagggggaagatagtgatcaggaggatcgacaactcgacgaacaggcaggtgaccttctcgaagcggcggggcgggctgctgaagaaggccaaggagctctccatcctctgcgatgcggaggtcggcctcgtcgtcttctccagcaccggcaggctccatgagttctccagcaccaacatgaaagctgtgatagaccggtataccaaggcaaaagaggagcagcctggcgtgaatgcaacttcagagattaagctttggcaaagggaggcagcaagcttgaggcagcaactgcac

SEQ ID NO: 802 - DNA, 911 bp, Triticum aestivum
cgaccggccagccggcaggatagagatctagagaggaagaagaagaagaaagaagaagaataagatggggagggggaagattgtgattgagaggatcgacaacccgacgaatcgtcaggtgaccttctccaagaggcgcggagggctgatgaagaaggcccgggagctcgccatcctctgtgacgccgatctcgcgctcatcgtcttctccagcaccggtcgcctctacgactttgcgagctccagcggaatggaggcaatactagagcggtaccaggaggcgaaagaggagcactacggggtgctgaatccaacatcagaggcaaagttatggcagagggaggttacaaccttgaggcagcaagtgcaaaacttacaacacaataataggcaactgttgggagaggagctatctggcaccactgctcgagatctgctgtttttggtgaaccaagttgagacgagcttacattccgtaagaaagaggaaggagcaacttatggctgcagagattcatgaactcaaccaaaagggatttcacattcaaaaggaaaatgtagaacttggcaaaaagttgggcattgctcatgagcacaaaatagagccgcagaaaaagctttctggggtcatgagaacgagtgagcagcaagccagcggaagcagctcaaaagctgctgccggattattattgtcgactagagcacgtgaaccaaggatttttattgaccttgagttgcggcagcagaagcatgaggatgaataacacctactacctcgtccactacatgctcagtaaaagatatatgtgcttagtcgcatgccaaaccacattgttaaccaaatttactgatttgcatgaaactgcagcatcaacttgtattttcagtgcatgcgtggacgatggaagctcg

SEQ ID NO: 803 - DNA, 1130 bp, Triticum aestivum
  misc_feature (1118)..(1118): n is a, c, g, or t
  misc_feature (1121)..(1121): n is a, c, g, or t
cacccaaccaacatcacctcacctcacctcactcaccaccattgccgcacttcagagcaactcgacccatcgacaccggccagacaccacctcgtgcacgaccaccatggaccagtacaactacggcggcggcgtggcctactacggcagcaccaccggcggcgtaggcgacaacggccagggcggcgggtacgcgacggtgacgtcggcgccgccgaagcggccggcggggcggaccaagttccgggagacgcgccacccggtgtaccggggcgtgcgccggcgcggcgcggccgggcggtgggtgtgcgaggtgcgcgagcccaacaagaagtcccgcatctggctcggcaccttcgccagccccgaggccgcggcccgcgcccacgacgtcgccgcgctcgcgctccggggccgcgccgcctgcctcaacttcgccgactcggccacgctgctcgccgtcgaccccgccacgctccgcacccccgacgacatccgcgccgccgccatcgcgctcgccgagaccgcgtgccccgccgcgcccgcgtcctcgtcgtccgtggccgccgccgtggcgtccgcgccggcgcccccgatgacgatgatgcagtttgacgactacgcgatgcagtacggcggcattggggacttggaccagcattcctactactacgacgggttgagcgccgccggtggcgactggccgagcggctcgcacatggacggagccgacgacgactgcaacggcagcggtggctacggcgccggcgaggtcgcgctctggagctactgatcgagctgctcgattgagccattctccagcccggtcagctttctccgatggggctgccgtacaacatcactcagcgtaggataaagaagaagcagagagggaacgggagcttcagttctgaagtagtactaagtactagttctgtgttccgtaaagcagagagggcacgggaatgcaagttgcatcaacctgtttccctcccttaattttttttcattttttgataatttttggttggcaagattttttgtaacatgtgctggagtagttagagtaataagagacaactccgctttactaatatatatctgaagtaattttgccnagntttccaaaa

SEQ ID NO: 804 - DNA, 1175 bp, Triticum aestivum
cgcgctgcggcctctgccagggacgcgcgcaccaccatcctgctgctccggggagcggccacctttggcgccggcggcgaaggaagggacggacacgggctgcagaggagagggcggccatggctgctagctagctaagtgggaaagagtacgtaggaagatagaaagagagagagagagagagagagagagagagagaatggggatgaggacgtgcagcgcgaaggaaggggtgaagagaggggcatggacgagcaaggaggaccaaaccttggcctcctacatcaaggcccatggcgaaggcagatggaaggaagtccccctcaaagccggtctgcggcggtgcggcaagagctgccggctgcggtggctcaactacctccggccgagcatcaagcggggcaacatctccgacgacgacgaggagctcatcgtcaggctccaccgcctcctcggcaacaggtggtccctcatcgcgggcaggctgcccggccgaacagacaacgaaatcaagaactactggaacagcacccttggccggaaggcgctcccggcgcgactggacaccaccaggacggtcgccacaccctgcccctccgccagctccggctcctccaccggggcgtcgacagcatggctttcctctaactgcggggatggtacaagtgccaaggctgcggggctgctgtcgtcggcctcggtgtgggtgcccaagcccgtgaggtgcacaggcggtctcttcctcagccgggatgcgccgcccccgccggtcatggagacgcgggccgtgggaggagacgcagatgagtgcagcggcagcagcttggcggcatcgtcgggcggcggcgactggatggacgacgtgagagccttggcgtcgtttctcgagtccgacgaggactgggtcaactccctgcacatggcggattaacgctcacactttttctcagcacgtgcacgtttatcactacgtacgaacagggagctgtatcgatacagctccatgcgtgtacgtaggttggcttcgtgctgagtactgactaatcagtagctacctgtgatggacttctaatcatactcacactctctcgagctgtttagtggatggtgtatgagtgggtgtgttcaaccgaataaaaaaaaaaaaaaaaaaaagtactagtcgacgcgtggcc

SEQ ID NO: 805 - DNA, 2940 bp, Artificial sequence
  Synthetic construct
atggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtgtccatgggcaagggcgaggaactgttcactggcgtggtcccaatcctggtggaactggatggtgatgtgaacgggcacaagttctccgtcagcggagagggtgaaggtgatgccacctacggaaagctcaccctgaagttcatctgcactaccggaaagctccctgttccgtggccaaccctcgtcaccactttcacctacggtgttcagtgcttctcccggtacccagatcacatgaagcagcatgacttcttcaagagcgccatgcccgaaggctacgtgcaagaaaggactatctctttcaaggatgacgggaactacaagacacgtgccgaagtcaagttcgaaggtgataccctggtgaaccgcatcgagctgaaaggtaagtttctgcttctacctttgatatatata

SEQ ID NO: 806 - DNA, 1446 bp, Artificial sequence
  Synthetic construct
atggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaagttttggcaaagggaggcagcaatgttaaggcaacaattacacaatttgcaagaaagtcaccgcaggaaaatgatgggggaagaactgtcaggcttgacagtcaaagaattacaaaatttggagaaccaattagaaattagccttcatggtgtccgaatgaaaaaggatcaacttttaatgggtgaaatacaagagctaaatcgaaagggaaacctcatacaccaagaaaatgtggaactgtataagaaggtctatggaacacaagatgataacgaaacaaacagagattctgttctgacaaatggtctaggcataggagaggatttgcaagtgcctgtgaatctccagctaagccagccacagcaacagcaacaacactacaaggcatcttcaggaactacaaaattgggattgcaattgcataacccagcggtactcgctgaggcgatcgcaatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctc

SEQ ID NO: 807 - DNA, 1482 bp, Artificial sequence
  Synthetic construct
atgggaaggggcaagatcgcgattaagaggatcaataactctacgagccgtcaggttacgttctcgaagcgaaggaatggattgttgaagaaagctaaggagcttgcgattctctgcgatgctgaggttggtgtcatcatcttctccagcaccggtaggctctacgatttctccagctccagcatgaaatcggtcatagagagatacagcgatgccaaaggagaaaccagttcagaaaatgatcccgcttcagaaattcagttctggcaaaaggaggctgcgattctaaagcgtcagctacataacttgcaagaaaaccaccggcaaatgatgggggaggagctctctggactaagtgtagaagctttacagaatttggaaaatcagcttgaattgagccttcgtggcgttcgaatgaaaaaggatcaaatgttaatcgaagaaatacaagtacttaaccgagaggggaatctcgttcaccaagagaatttagacctccacaagaaagtaaacctaatgcaccaacagaacatggaactacatgaaaaggtttcagaggtcgagggtgtgaaaatcgcaaacaagaattctcttctcacaaatggtctagacatgagagatacctcgaacgaacatgtccatcttcagctcagccaaccgcagcatgatcatgagacgcattcaaaagctatccaactcaactatttttccttcattgcaaacccagcggtactcgctgaggcgatcgcaatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctc

SEQ ID NO: 808 - DNA, 2251 bp, Zea mays
gcacgagaccattacctagaacatcctaatcgaaaagcttccagctccggcccggtgtgctccgcaggctccacctccgcgtcctctcaagtctcaaacgctcaaggtctcaccggagaccgcgccgcgccccgcgggcttctggtagctcgggatggcctccgggggctcggccgcacgtgacgcgtacgacgaggaggccgccgtccgccgccccctcgagctcgatagccgtgacgccgccgcctcgtcctccgaccactggcccggtgggaatgccatgcctaggtatcaagtgggcttgacaaaggatgattcaagtagtagacactctgagtggcggcagcctagcacagatgatgtgcgcaagagcaagctcgggccaagatacttcacggcgtttggcgtggatctgtcccctgataatatggcagttgccattgtctattttgtgcaaggggttctgggtcttgcacggcttgctgtgagcttttacttaaaagatgatctccatctagatccagctgagaccgcagtggtatctggtttctcatccttgccgtggttgatcaagcccctctatggctttatcagtgattccattccactctttggatatcgaaggaggtcgtacctttttctgtcagggttacttggagcactttcatggagtttaatggccacagtagtgagcagtaaatacagtgcagcatcctctattcttcttggctcactttctgttgccttctcagatgttttgttagaaatcatcgaagtgatggtagtggattctatggttgttgagagagcccgtggagaatctcaaagcacatctggatcactccagtcgctctgttggggatcttctgcctttggaggaattgtgagtgcttacttcagcggttcgcttgtggatacttatggagtaagatttgtctttggtgtaacagcgtttttacccctgatgacatctgctgttgcagttcttgtaaatgaacatcgcatatcttctggagaacgtactaccttacactctggttcaggattcgttgagagttctaagcagcacgtcaggcagctttggacttcagtaaagcagcctaacatattgttgccgaccttgtttatatttctttggcaagcaacaccacagtcagattctgctatgtttttcttcatcacaaataagcttggattcacaccagagtttctagggcgtgtgaagcttgtaacctcctttgcatccctgctcggtgttgggctctacaactattttctgaaggaagttcctctaaggaaaatatttctcgtgacaaccattataggttcagctcttgggatgacacaggtgcttcttgtaactgggctaaatcggaagtttgggattagtgacgagtggttttctattggtgattcattaatcatcacagtccttggtcaggcttcatttatgccagtcttggtgttagctgcaaaactgtgccctccaggaatggaagccactttatttgcaactttgatgtcaatttctaatgctggaagtgttactggtggtctggttggtgctggtctaactcggatatttggggtcaccagggacacctttgggaacctacctctattgattgtcgtctgcaatcttagttcgctgctgcccttacctcttctaagtctcctgccagaggaatcaggtgacacagacaatggagaaacaaagaatatctgacttgctgagggtttcatctctgtttgttctgattctcaagtatagcataccacagtgcccagcttcaactcagatatgacccatccagttgaagttcaaaagatcagtgggcaaatatgaaaatcatactggagataagttcagttagtcaccaccaccatcagccagtatctcctgcgactattaacctgtgatcaaagcgattcattggtgatcaaaacgactattaacctgcgattcattggcgcacaggtaatcaccactttttttagtttatataagttaccttgcatacgaaggcaaggtcggttttatctttctctacattctttgagttttttgttagctaatgctgcgaccccatgaaaactagagtaggggtcaaagactagtagttgaggattcccttacaaagtcgaatgtattgtaaccaaaaaaaaagagagggaatatttatgcattatggaggcctagagtacggacacgtaaaggaaaatacttgcacacagaaaaaaaaaaaaaaaa

SEQ ID NO: 809 - DNA, 2042 bp, Zea mays
gcggcgcggcgagactgctgagcccgaggaaacgggaagagaggagaaaagcaaaacgaagctcggaaccacgagacgacggagaggatgggcttcagcgtcctgctctcaccgccgccccttccgctcccgagcgccaccgctgcggccgacttgtacctaatattcggcggccacgatcgccgccgccgccgcccgctggaacacggctgccgctgcggccgccccccggagacggcgctcggcggcagctcaggccgccgcggctcgtacgatgacgacgggacggctccaggctccctcggcctcgacggcagcagcacgtcctcctcggtccgtcggacggggagtgcaaaaccaagatatcaagtaacttcgaaagaagaggacacacaaaatgcagaccgcgaggggtggcaatatagtacagaaggcctttcaaagagcatgtccaagtcaaggtacatcaaagtatttggggttgatttgtcccctgataatgtggctgttgctattgtttacttcgtgcaaggagttttaggcctttcgaggcttgctgtcagcttctacttaaaagataatcttcatcttgagccagcagagactgcagttatatctgggttctcagccttgccatggttggtcaagcccctctacggttttatcagtgattccatccctctctttggatatcgaagaaggtcgtacctatttctatcaggcatccttggagcactttcatggagtttgatggccgctgttgtggatgataaatatagtgcagcactctctattattcttggatctcttgcagttgccatatctgatgttgtggttgattctatggtggttgagagagctcgaggtgaatcacagagtacatctggatctctccagtcgctatgttggggatcctcagccttcggaggagtcgtgagtgcatacttcagtggttctttagtggatacttatggtgtaagatttgtttttggtgttacagcacttctgccactgatgacatctgctgttgcagttcttgtaaatgaagaacgcttacctttggggaaaagttcagtctcactttcagtttcaggttcagaattaattgagagctctaagcaacgtatcatgcagatttgggattcagtaaagcaacccagcatactcctacccaccttgttcatattcctttggcaagcaacaccgcaatcagactctgccatgtttttcttcataacaaataagctcgggtttactccagaatttctaggacgtgttacgcttgtcacatctgttgcatccttactgggaatcggagtgtataatttgtttctgaaggaagttccattgaggaaaatctttctagtgacaacagttttaggttctgctcttggaatgacacaggttcttcttgtcactgggctcaaccggaagcttggcataagcgatgaatggttctccattggggattctttgattatcacagtccttggccaggcttcctttatgcctgtcctggtgttggctgcaaaattgtgccctgtgggagcggaagcaactttatttgccactttgatgtccatctctaacgccggaggtgttgccggaggtctggtgggcgcgggtctgacgcagttactgggagtcagcagagacaacttcgaaaaccttgctctgctgatcgcgatttgcaatctcagttccctgctacctctgcctcttctgggtctcctgccagatgaatcccgtaatgcagatggtgcacagaccaaaaatgactgatgcttgtatatctccacgcgtctttacaagacgaaagggcatacacatacactcatcggcacaaagcagcgcagctgatgacgtgaacaaaacatggaagctgatgtataggatgtattatctatgatgtatagtaagtaacgttagattaattatgaaacatatttgtaataattttaattgaaagtataaatactccttttcataaaacgagaaaaaaaaaaacaaaaaaaaaaaaaaaaggtttacatttttttcgg

SEQ ID NO: 810 - DNA, 1812 bp, Zea mays
atgggcttcagcgtcctgctctcaccgccgccccttccgctcccgagcgccaccgctgcggccgacttgtacctaatattcggcggccacgatcgccgccgccgccgcccgctggaacacggctgccgctgcggccgccccccggagacggcgctcggcggcagctcaggccgccgcggctcgtacgatgacgacgggacggctccaggctccctcggcctcgacggcagcagcacgtcctcctcggtccgtcggacgggtgagccgcgctggcttattagctatatcgtaattgtaaagcaattctgtgtggtaactgactgttgcaggaatttcttatggtcatccagaaaacattcaggagaccccttttttctaagcctggactaccaagggagtgcaaaaccaagatatcaagtaacttcgaaagaagaggacacacaaaatgcagaccgcgaggggtggcaatatagtacagaaggcctttcaaagagcatgtccaagtcaaggtacatcaaagtatttggggttgatttgtcccctgataatgtggctgttgctattgtttacttcgtgcaaggagttttaggcctttcgaggcttgctgtcagcttctacttaaaagataatcttcatcttgagccagcagagactgcagttatatctgggttctcagccttgccatggttggtcaagcccctctacggttttatcagtgattccatccctctctttggatatcgaagaaggtcgtacctatttctatcaggcatccttggagcactttcatggagtttgatggccgctgttgtggatgataaatatagtgcagcactctctattattcttggatctcttgcagttgccatatctgatgttgtggttgattctatggtggttgagagagctcgaggtgaatcacagagtacatctggatctctccagtcgctatgttggggatcctcagccttcggaggagtcgtgagtgcatacttcagtggttctttagtggatacttatggtttcactgatcatgtgtcccatgaatgcagatttgtttttggtgttacagcacttctgccactgatgacatctgctgttgcagttcttgtaaatgaagaacgcttacctttggggaaaagttcagtctcactttcagtttcagatttgggattcagtaaagcaacccagcatactcctacccaccttgttcatattcctttggcaagcaacaccgcaatcagactctgccatgtttttcttcatcgctcgccatccacgcccacgcaggccgcagctgccaccggccactcgctcggagatttgatctgctccaaccagcaaccaccacccctgggggaaaaggcgtcagcggtgcggttgctggcggctggccagcaaccaaaccacaccctaaaatgcatatttcctcaggttcttcttgtcactgggctcaaccggaagcttggcataagcgacgaatggttctccattggggattctttgattatcacagtccttggccaggcttcctttatgcctgtcctggtgttggctgcaaagttgtgccctgtgggagcggaagcaactttatttgccactttgatgtccatctctaacgccggaggtgttgccggaggtctggtgggcgcgggtctgacgcagttactgggagtcagcagagacaacttcgaaaaccttgctctgctgatcgcgatttgcaatctcagttccctgctacctctgcctcttctgggtctcctgccagatgaatcccgtaatgcagatggtgcacagaccaaaaatgactga

SEQ ID NO: 811 - DNA, 2081 bp, Zea mays
ccacgcgtccgattctcaatgaacgtgagaaattggtttccttctatattgagctttttattctattatatatgactaaaacagctacttcatacactatttccacttcaaggctcttgttcttactagctttctagtttgcattataataatgcacctttctggcaaaccaacactgctctcaagaaaatgttggtcaatcccaacataattatatttctagttcaagttttacacggtaaggctggccacttgaaccaatttttagttatttatgctattcaaattaatcaatttagggctagtttggatactttgggattagagtgttttggagggattggagagggtgtaaatccccaatagatcaaatactctctctcaatacatctcaatccactctaatcccactcattactagagtacccaaactaggccttattgggggctgtctagccctaaaactggatgtatctggccaaatgtgccaatgtgataaacttttatccatgtttattttttattgtataaaaattatcatcatatcatttccacctcctgctgggactgtagaacaagaacttttgcatgtatattgcttcaaggtttgtctcagccacatgtgggaacactgtaggtagtggattctatggttgttgagagagcccgtggagaatctcaaagtacatctggatcactccagtcactctgttggggatcttctgcctttggaggaattgtgagtgcttatttcagtggttcacttgtggatacttatggagtaagatttgtctttggtgttacagcgtttttacccctgatgacatctgctgttgcagttcttgtaaatgaacatggcattccttctggagaacacaatacctttctctctggttccggatttattgagagctctaagcagcatgtcaggcagctttggacttcagtaaagcaacctaacattttgttgccgaccttgtttatatttctttggcaagcaacaccgcagtcagattctgctatgtttttcttcatcacaaataagcttggattcactccggagtttctagggcgcgtgaagcttgtaacctcttttgcatccctgcttggtgttgggctctacaactattttctgaaggaagttgctctgaggaagatttttcttgtgacaaccattataggttcagctcttgggatgacacaggtgcttcttgtaactgggctaaatcggcagcttgggatcagcgatgagtggttttctattggtgattcattaatcatcacagtccttggtcaggcatcgtttatgccagtcttggtgttagctgcaaagttgtgccctccaggaatggaagccactttatttgcaactttgatgtccatttctaatgctggaagtgttactggtggtctggttggtgctggtctaactcggatatttggggtcactagggatacctttgggaacctacctctgttgattgtcgtctgcaatcttagttcattgctgcccttacctcttttaggtctccttccagagggatcaggtgacaccgataacggagaaacaaaaaataactgatttactgagggttttatctccattgttctggtactcaagtattgcataccacagtgcccagcttcaactcagatatggcccatcgagttgaaattcaaaaggccagtagagaaatacggaaatcacactggatttaagttcagtcggtcaccgccatcatcaggcagtatctcctgtgactattaacctgtgtgatggaagtgattcattgatgatctgcaaatgatctatggcgcacaggtactcacctctttttagtttctaagctatcttgtacacgaagacaaggtaggttttatcttttctctagagtctttgagtttttgttgttaatgcgaccccatgagaattagactagtggtcaaaggctattaattggggattaccttgcgaagtcaaatgtattgtgacaaaaaaaaggagggagtatgtatacattattggaaacctagagtacggaaatgtaaagaaaaatatttgcacaaaaaaaaaaaaaaag

SEQ ID NO: 812 - DNA, 2290 bp, Zea mays
cattgggtacctcgaggccggccggggcgctgcgccaatctcgcttccaacatctccggcccatcgcccgtgctctctgcactgtctcgcctccgacctccgcgccctctcaaggtctcaccggagaccgcgctgcggtccgcgggctttgggtagcgcgggatggcctccgtggggtgggctgcacgcgacgcgtacgacgaggaggccgcagtccgccgccctctcgagctcgagggccgtggcgtcgccgcatcgtcctccgaccaccggcccggcgggaatgtcatgcctaggtatcaagtgggctcgacaaagggtgattcaagtagtagacgacactctgaggagtggcggcaacctagcacagatgatgtgcgcatgagcaagccggggtcgagatatttcacggcgtttggggtggatctgtcccctgataatatggcagttgccattgtatattttgtgcaaggggttttaggtcttgcacggcttgctgtgagcttttacttgaaagatgatcttcatctagatccagctgagactgcagtggtatctggtttctcgtccttgccgtggttgatcaagcccctctatggctttatcagtgattccattccactctttggatatcgaagaaggtcatatctttttctgtcagggttacttggagcactttcatggagcttaatggccacagtagtgagcagtaaatacagcgcagcattctctattcttcttggctcactttctgttgccttctcagatgttgtagtggattctatggttgttgagagagcccgtggagaatctcaaagtacatctggatcactccagtcactctgttggggatcttctgcctttggaggaattgtgagtgcttatttcagtggttcacttgtggatacttatggagtaagatttgtctttggtgttacagcgtttttacccctgatgacatctgctgttgcagttcttgtaaatgaacatggcattccttctggagaacacaatacctttctctctggttccggatttgttgagagctctaagcagcatgtcaggcagctttgggcttcagtaaagcaacctaacattttgttgccgaccttgtttatatttctttggcaagcaacaccgcagtcagattctgctatgtttttcttcatcacaaataagcttggattcactccggagtttctagggcgcgtgaagcttgtaacctcttttgcatccctgcttggtgttgggctctacaactattttctgaaggaagttgctctgaggaagatttttcttgtgacaaccattataggttcagctcttgggatgacacaggtgcttcttgtaactgggctaaatcggcagcttgggatcagcgatgagtggttttctattggtgattcattaatcatcacagtccttggtcaggcatcgtttatgccagtcttggtgttagctgcaaagttgtgccctccaggaaatggaagccactttatttgcaactttgatgtccatttctaatgctggaagtgttactggtggtctggttggtgctggtctaactcggatatttggggtcactagggatacctttgggaacctacctctgttgattgtcgtctgcaatcttagttcattgctgcccttacctcttttaggtctccttccagagggatcaggtgacaccgataacggagaaacaaaaaataactgatttactgagggttttatctccattgttctggtactcaagtatagcataccacagtgcccagcttcaactcagatatggcccatcgagttgaaattcaaaaggccagtagagaaatacggaaatcacactggatttaagttcagtcggtcaccgccatcatcaggcagtatctcctgtgactattaacctgtgtgatggaagtgattcattgatgatctgcaaatgatctatggcgcacaggtactcacctctttttagtttctaagctaccttgtacacgaagacaaggtaggttttatcttttctctagagtctttgagtttttgttgttaatgcgaccccatgagaattagactagtggtcaaaggctattaattggggattaccttgcgaagtcaaatgtattgtgacaaaaaaaaggagggagtatgtatacattattggaaacctagagtacggaaatgtaaagaaaaatatttgcccccagaaaaaaaaaaaaaaaaaaaaaaaaaaaaaaaaaaagggcgggctctagagtatccctcgaggggcccgaagcttacgcgtacccag

SEQ ID NO: 813 - DNA, 1983 bp, Zea mays
atggcgggcctttttctgagggagagacagagacgttggcgcggcgcggcgagactgctgagcccgaggaaacgggaagagaggagaaaagcaaaacgaagctcggaaccacgagacgacggagaggatgggcttcagcgtcctgctctcaccgccgccccttccgctcccgagcgccaccgctgcggccgacttgtacctaatattcggcggccacgatcgccgccgccgccgcccgctggaacacgggctgcccgctgcggccgccccccggagacggcgctcggcggcagctcaggccgccgcggctcgtacgatgacgacgggacggctccaggctccctcggcctcgacggcagcagcacgtcctcctcggtccgtcggacgggtgagccgcgctggcttattagctatatcgtaattgtaaagcaattctgtgtggtaactgactgttgcaggaatttcttatggtcatccagaaaacattcaggagaccccttttttctaagcctggactaccaagggagtgcaaaaccaagatatcaagtaacttcgaaagaagaggacacacaaaatgcagaccgcgaggggtggcaatatagtacagaaggcctttcaaagagcatgtccaagtcaaggtacatcaaagtatttggggttgatttgtcccctgataatgtggctgttgctattgtttacttcgtgcaaggagttttaggcctttcgaggcttgctgtcagcttctacttaaaagataatcttcatcttgagccagcagagactgcagttatatctgggttctcagccttgccatggttggtcaagcccctctacggttttatcagtgattccatccctctctttggatatcgaagaaggtcgtacctatttctatcaggcatccttggagcactttcatggagtttgatggccgctgttgtggatgataaatatagtgcagcactctctattattcttggatctcttgcagttgccatatctgatgttgtggttgattctatggtggttgagagagctcgaggtgaatcacagagtacatctggatctctccagtcgctatgttggggatcctcagccttcggaggagtcgtgagtgcatacttcagtggttctttagtggatacttatggtttcactgatcatgtgtcccatgaatgcagatttgtttttggtgttacagcacttctgccactgatgacatctgctgttgcagttcttgtaaatgaagaacgcttacctttggggaaaagttcagtctcactttcagtttcaggttcagaattaattgagagctctaagcaacgtatcatgcagatttgggattcagtaaagcaacccagcatactcctacccaccttgttcatattcctttggcaagcaacaccgcaatcagactctgccatgtttttcttcataacaaataagctcgggtttactccagaatttctaggacgcgttacgcttgtcacatctgttgcatccttactgggaatcggagtgtataatttgtttctgaaggaagttccattgaggaaaatctttcttgtgacaacagtcttaggttctgctctcggaatgacacaggttcttcttgtcactgggctcaaccggaagcttggcataagcgacgaatggttctccattggggattctttgattatcacagtccttggccaggcttcctttatgcctgtcctggtgttggctgcaaagttgtgccctgtgggagcggaagcaactttatttgccactttgatgtccatctctaacgccggaggtgttgccggaggtctggtgggcgcgggtctgacgcagttactgggagtcagcagagacaacttcgaaaaccttgctctgctgatcgcgatttgcaatctcagttccctgctacctctgcctcttctgggtctcctgccagatgaatcccgtaatgcagatggtgcacagaccaaaaatgactga

SEQ ID NO: 814 - DNA, 1004 bp, Zea mays
acaagtttgtacaaaaaagcaggctggtaccggtccggaattcccgggatcttccactcatgagaggcacggcaccagagctccagctccacatcgccagctcccgggccgcacctcgatcgcccaggccggcctcctccctcgccgccggcgccgccatggaccgcaagagcaagtccgccaagggcgccgcgagctcggcagcggcgtccatggccgcgctcgccgcagccgccgcggccggcgacagcagatcgggccccggcggcggcggcgtctgtcgttgcggcaggcggcggcggcgggccgaggtgccaggcggagcggtgcaacgcgaacctgatgaccgaggagaagccgtacaaccggaggcacaaggtgtgcgaggcgcactccaaggcccccgtcgtgctcgtcgccggcctccgccagcgcttctgccagcaatgcagccggttccacgagctgtcggagttcgacgacgtcaagcgcagctgccgcctgcgtctggccggccacaacgagcggcgccggaagagctcggccgacgcgcacgccggcggcggcaataatggattccgccaacacgccgaccagaacggccgcggcgacccggccgggaaccacttccagatcagataaagcatgcctctctctcttctgtcatgcagcaggatatgctagcatcatcactaccgatagatatttatgcgtctatcgtctacccgccccgaaaaccctagttatatatatatatatatatattttatatatatatatatatatatatatagacatatgctgattgtaacctaattagcctgcagccagttaagcagggactgcctactctgctaggaggacgtgtgtaatcatgtggcctgcgcaaacagtaatttgtgctggctgctgtgtattcatgctgctctgataatcgtgtcgtggtaataatatatcctatttattctactactagtaatcggacgcgtgggcggacgcgtggg

SEQ ID NO: 815 - DNA, 1399 bp, Zea mays
gccggccgggccgggaccttacctcctcacgcctgtatagctttcgtcgtcttcggctaagttttaaaagtgaaaacgatgaattggaacttgtatctgggatgaggttctgaatcagtcatcaaattggtgcttctctgcgccagtacaaaacacagaggacgcaggatctgtgcagtagttttttgctttgacaagaaccctcaaatcttcaagccccatcttttcaagttgttgcatacgtttcacttgctcgcggagtttgacgaggccaagcgcagctgtagaaagaggctcgatgggcacaaccggcgtcgcaggaagccgcagccagataccatgagctctgggagctttatgtcgagtcaacaagggacgaggttctcgtcgttcccggttccaaggccggagccgagctggcccggagtcatcaaatccgaggacagcggctcatactacgcgcaccagcgccacccggtcctaagcagcaggccgcacttcgccggcgggggctccacgccgccggcctactcgtccaaggaaggccggcgcttcccgttcctccaggacggctgcgaccagcagcaggtcggcggcttcagcgcgggcgcgggggcgcagcagctcgaggtctcttccacgtccacggtgtgccagcccctcctcaaggccgccgccgccgccgccccaccgccgccgccagagagcagcagcagcaacaagatgttctccgacgggctcgcccccgccgtgctcgactcggattgtgctctctctcttctgtcatcccccgccaactcctccagcgtcgacgtgggccggatggtcgtccaccagcccgcggagcacatccccatggcgcagcccctcgtccccggcggcctccagcagcagcagcagcaccacccgttcggcggctcccccgcctggttcgcctgctcccaggccggctccagcgccgtctccgccggcggtttcgcctgccccccgggcgtggagagcgagcagctcaacaccgtgctggtgccgagctccgacggtggcggccacgacatgaacatgaactaccacggcatattccacgtcggcggcgacggctcctccgacgggacgtccccttcgctcccgttctcgtggcagtagctagctttccaattcaagcgtccagcagtctatcgtttcagctgtactagtggtcatcgcaccagttccctcttctttcctcgttttatttatttactagtggatggcgcgcgccctgcgcgcgttgtaaaattcaattctagagcatttggatatatctaaatttaaattattgcattttacaatcaataatctgtatggttaggcaaagttaaaacagtagattgtatcattgcaaaaaaaaaaaaaaaaaaaa

SEQ ID NO: 816 - DNA, 1676 bp, Zea mays
cgttattttaagggcggcgccaccactgttgtcgcctccttcctcactgcctcctcctacccttccctcgctgaagccctctcgcgcctcctcccactcccactggacagagaggaggttagtggaaggcgggctaggaggctacgccgccacagacgcgaagcgatagcgtcggggggaagcaaggaagcgggtggcaatggcgaccggcggcggcggtgggagcgacgacttccacgggctcacgttcggccagaagatctacttcgagcaggacgcgggcgccgccggggggagcgcgacgggcggcaggaaggggaagggcgccgcggcgtccgcgagcgccgcccagccgccgcggtgccgggtggacgggtgcggcgtggatctgagcgccgtcaagcagtactactgccggcacaaggtgtgctacatgcactccaaggagccgcgcgtcttcgtcgccggcatcgagcagcgcttctgccagcagtgcagcaggttccaccagttacctgaatttgaccaagggaagcgaagctgccgccgccgcctcattggtcacaacgagcgccggaggaagccaccacctggaccactcacctcacgatacggcccgcttgctgcatcactagttcaagagcctggtaggttcaggagcttcctgctcgacttctcgtacccgagggttccaagcagcgtgagagatgatgcgtggcaatggcaagggatgcagcatggcggcgacaggatgctgctgggtaccgccagcgccatccagtggcatgggaaccaagaacctcacccaccacatcgcagcgcagctgcgggctatggcaaccatgcgtacaacaactgccatggtggcggcggcttggtagcagcagcagcgggggcgtcaatgctctcctctgccttcgagcccccgcctggcggtggcggatgtgtcgcaggagctaccgcggccgactccagctgtgctctctctcttctgtcaactcagccatgggatacgcccacccaaagtggcagcagccaccacaaccggtccccagcgatgtccgcggctgcaggcgccttcgaagtggcgccgtcgtccgtcgtggcgagcagctacacggcgtcgagctcctggtctggctcacgggaccctgccgacggcgccaggaaaaacgcgcagcgtcacgatgatggcctgcacctggtccatccaccaggccccgtccaccacggccacttctccggcgagctcgagctcgccctgcagggaagcggcccgccgcatgtcgaccatggcggcggcacctgcttcagccattctgacaccaacgcgatgaattggtccctgtagggacaacaacttttgccgccactgccttgatccggtcggcacgccacgagacatggagcacttgggattgggacaccctggttttgtgcccctgaccttgccgttctggtttttcagggtggaactaactgggattccctaggcgtagatcatgaatcccctttccccgtgtaacccattgcgtccatgaagtcggcccaacaccggatcatatataattctacaactcccataacctaaatcattcttcagttgtgaagatatatgcttgtcaagtgacctggttttattttatctgccatcaattcatcatcatcacttcttt

SEQ ID NO: 817 - DNA, 1197 bp, Zea mays
gtttcacttgctcctagagtttgatgaggccaagcgcagttgtagaaagaggcttgacgggcacaaccggcgccgcaggaagccgcagccagataccatgagctctgggagctttatgacaagtcaacaaggcttgttttcgagtgcagggacaaggttatcgtcgttcccggcaccaaggccggagccaagctggtctggagtcatcaaatccgaggacagctcatactacacacaccacccggtgctcagcaacaggccgcacttcgccggcacctccacgtcgccggcctactccaaggaaggccggcgcttcccgttcctccaggacggcgaccaagtcagcttcagcgcatcaggcgccgggacgctcgaggtctccacggtgtgccagcccctcctcaagacgaccgccgccgtggccccgccgccgcccgagagcagcaagatgctcgcccccgtgctcgactcggattgtgctctctctcttctgtcatcccccgccaactcttccagcgtcgacgtgagccggatggtccagcccgcggagcgcatccccatggcgcagcccctcgtccccggcctccagcaccaccagttcggcggctccccggtgccggactggttcgccggctccggcgccgtccctgccgcgggcaccggcgggttcgcctgcccccacagcgtggagagcgagcagttcaacacagtcctagtgccgagctccgacggcggccacgagatgaactaccacggcatattccacgtcggcggcgagggctcctccgacgggacgtccccttcgctcccgttctcgtggcagtagcttaccgttgaagcgggcagtgttatgatcggtcagctgtatagcggtggtcatcacaccagttccctcttctttccgtgtttatttattctctgctccctcacgcactcccccgtgtcacttgctagtttcttagttttgcatgcctgatgcatgtagcctgaaaaaactctatcaaattagtgccagatttcctagttcccgtttgtttcattttattttgagaattggaatcttactaatgatttcctagttcccgtttgtttcattttattttgagaattggaatcttattaatgtaataggctattttttagaatgtgacattccaccactttccaaagttattgtataagcctaaaaaaaaaaag

SEQ ID NO: 818 - DNA, 2843 bp, Zea mays
atggcccgcgctgtagctgacactgacgactggaccggggccgtacggtccccgccggccggccggccggcctgcctgctgcgtaccctctcggcctgcccccgcaccgcaccgcaccaggcttttgcgggtcgctgtgcgaggctgcactttgacaggtgggacacggtgactcaggtcccactgggcagtggggtgcgctcggcggtggaattttggtacgcgatgcgcaaagccttttgtggcgtctggttccggatacgggatctttcgagcaagtggcagagccgcctgttttctaacccgtcacccaggcagatcttagccaatgacgttcgggacccacctgacggagactccacatgtcatccgcgtctccctatggcccgagtcccattcgggcagcagcatcatcagccgccgccgccgccgccgcgcttccactttgtcttgagccctgccctcaacgacgactcgcgggccggcagcacagcacgtatagctatggaaggaaacggtggcgcgggcggcggtagcggaagcgcggcaccgccctgggatctcgccatgcactgggcacccgccgtagtgtcgtcctacccgccgcagcccttggagctgcagcagcaggagcttacctgcctcaagctggggaagcggcccgcctgctgctgggcaggggcgccgggcaaccaagcggcgcaggtccacggcaatggcggcgctggtggcgcagctgctgagggtaagaggaaggacaaggcgcctgccgcggcggccgtgacgaggtgccaggtggaggggtgccacctgtcgctggcggacgccaaggagtaccaccggcggcacaaggtgtgcgaggcgcactccaaggcgccccgggtcgtcgtcctcggcgccgagcagcgcttctgccagcagtgcagccggttccacgcgatctcggagttcgacgacgcgaagcggagctgccgacggcgtctggccgggcacaacgagcggcggcggaagagcaacgccagcgaggccatggcaagaggcgtcgcgcacccacacggagtgacggctttcggccacggcggcttcctgccctcgcgcggcctcgtccccgcagggtcgtccccggcggcggctggtgctctctctcttctgtcatcggccagaggcagcgtggcgggcgccagcgggccctggctggtcacggcggcgcgggaggacatcccggcgcgctccagcgcggcgctcgacgaccttatcgccgagaaccgcgccgccgcgctcctcgcgcggcagtacttcgtctccgaccgctcgccggcgcccagacgggatttcgtcgcctcttcgacggcgggttgctccctccagcagcagcagcacccgcccgaccacgaccacacagccggctggcacccgcacccccacccctacagtggcggtggcggtggcagctgtggtggtcggtaccagtaccaccacgtggcgccgccgagcgcgtggcacgcgacgacgctggaccttatgcagccgacagcaagcaccaccgccgctcccgccaccgccggcgcagcgttgtggccagcagtgccggagagggcgggcgcgaggtcgtctcgctctcgcagcgagaccaaggatggcgacgcgtcgggatgtagcggcttggacgcgtgggcgcccactggtggagctcgtgtgctgacacaggaggttgctcaggagcactttgccgctctcgtggacgtcgatcccaagccacttctagaaccgccttgcaaactcacagcgaaagagggcgagaccacacctccacagacagaggccgagcatgccagccggacgaggacgagccttcgtgtcgtcgagcagggcccggcggcccgtagcttaaggagtggcatggacaaactctgcaggagccttggcggcaagacgctgtctgcggcgcgagggagcaccaggacgctgacggcgcggcaggagcagcgtcagaggctgaggctgaagcgtcaagcaaagcagcaacagagacagcgcagcgggggcagcaagcgatggggagcgcggtggctaggggagcggatgcagcagggcgcgcggcgcagggtggcactggccataggcgagaagcgcgaaggaggccgagatgaccagcagagcagacgggcccgctccgaggcgcggcagcacaatccggcacggcggcagcggaagcacaggggacagaggcaaagcggggggcggcagcttttgcgagggaagcgccaccccactgggattggaacggggttgacggagcggcggggggcaggagagcgggcggtggaagggggtctgtacgcgagggatcggcatcttgcaggaggaccggattgcctgtggccggaggcgccacaggcacagcaccgcatggggtcgctcgcggcaatcacgcacgaagtgatcagacttcagaggcaaggcaacggaagccagccgaaggcgagcccaacttcggcagtttccagggaactggaggagggagcggttttgaaggcgaggtcgtggcctcagcagccgaaggcacagtccgatgtccccatccagcacgtctggttggagagcagtaatagcgtcttcttcaacccccggcagccgaattgcagcagcagcccgcatggcggacggcaaacaggggtgaggcgtcaacgagaggacccagccagcctaagcggcccaacccaactcatctcgaggcgccggaagctgctccacgccagcaccagcctcggtgcagcgccggtttttgaaaagctgtgcaccagcgagactgttctgaagctgtcatcgcccgacggcacctg

SEQ ID NO: 819 - DNA, 2216 bp, Zea mays
tacaaaaaagcaggctggtaccggtccggaattcccgggatgtctgaaagctgagctgagctctagctgatagaggtagccctccacaccacaccactcgcaatccacacaactacactgatacacctgcgctgcacttgcctctgcgagcacgtactggctgtggctgtgcctggcctcctcttcctcggtggtggtggtggtggtggtgcactggtgctggtcttgcgcctgcttgttcggttgttcctcacttccacttccacggctcccctcccaccaagcagactgcagtagcacatccccctccgcgcaccactcgcttcgacaccaccgggcaccgcccggcatctagctctagcggcagctcatctccctccctctggctggctgtttgtttctctctctctctcctccccatcaggataagctcagcagccccccctgctgatctgcggcatttgccctgttcccgtgctcgatttgttcgcttctgtgcgcgcgcggtggtgcccaggcaataactcccctcggtgtctggctggctcgttgccaccctccccgcggcagagcggcctataggatgagagggacaggggaacccaacaaaccggccgcggcactgtcctggccgtgaaagacacgcacacagagctccagctcggccacgggcacgggcacggccacgggcacgcggcgcctagctctgcactggccgacggggaaacggtcgagcttgctatccatcgcccgcgccgttcccattcatggattgggatctcaagatgccggtttcctgggacctgcccgacctggagcacgacgccgtgccgccgcccatcgccgccgccgcctccgccgcgccttcccccgcggcggcgtcgggcattgccgccgcagctgctgggcctccccccgcggcggcaccgcgcggggcgccgagccgggcggagtgctccgtggacctcaagctcggcgggctcggcgagttcggggctgcggacgggacgaaggagccggtagtggcagcggccgcggccgcggccgcggcgccgccgtccgctagcccgatgaagcgcccgcgctcggggcccggtggcgccgccggggcgcagtgcccgtcgtgcgcggtggacggctgcaaggccgacctcagcaagtgtcgcgactaccaccgccgccacaaggtctgcgaggcgcactccaagacgcccgtcgtcgccgtcgccggccgcgagatgcgcttctgccagcagtgcagcagggagggcaatgtaacatgcctgagacgtaggaatttgctatttgagagacagtttcacttgctcgcggagtttgacgaggccaagcgcagctgtagaaagaggctcgatgggcacaaccggcgtcgcaggaagccgcagccagataccatgagctctgggagctttatgacgagtcaacaagggacgaggttctcgtcgttcccggttccaaggccggagccgagctggcccggagtcatcaaatccgaggacagcggctcatactacgcgcaccagcgccacccggtcctaagcagcaggccgcacttcgccggcgggggctccacgccgccggcctactcgtccaaggaaggccggcgcttcccgttcctccaggacggctgcgaccagcagcaggtcggcggcttcagcgcgggcgcgggggcgcagcagctcgaggtctcttccacgtccacggtgtgccagcccctcctcaaggccgccgccgccgccgccccaccgccgccgccagagagcagcagcagcaacaagatgttctccgacgggctcgcccccgccgtgctcgactcggattgtgctctctctcttctgtcatcccccgccaactcctccagcgtcgacgtgggccggatggtcgtccaccagcccgcggagcacatccccatggcgcagcccctcgtccccggcggcctccagcagcagcagcagcaccacccgttcggcggctcccccgcctggttcgcctgctcccaggccggctccagcgccgtctccgccggcggtttcgcctgccccccgggcgtggagagcgagcagctcaacaccgtgctggtgccgagctccgacggtggcggccacgacatgaacatgaactaccacggcatattccacgtcggcggcgacggctcctccgacgggacgtccccttcgctcccgttctcgtggcagtag

SEQ ID NO: 820 - DNA, 1275 bp, Zea mays
atgcactgggcacccgccgtagtgtcgtcctacccgccgcagcccttggagctgcagcagcaggagcttacctgcctcaagctggggaagcggcccgcctgctgctgggcaggggcgccggggccgggcaaccaagcggcgcaggtccacggcaatggcggcgctggtggcgcagctgctgagggtaagaggaaggagaaggcgcctgccgcggcggccgtgccgaggtgccaggtggaggggtgccacctgtcgctggcggacgccaaggagtaccaccggcggcacaaggtgtgcgaggcgcactccaaggcgccccgggtcgtcgtcctcggcgccgagcagcgcttctgccagcagtgcagccggttccacgcgatctcggagttcgacgacgcgaagcggagctgccggcggcgtctggccgggcacaacgagcggcggcggaagagcaacgccagcgaggccatggccagaggcgtcgcgcacccacacggagtgacggctttcggccacggcggcttcctgccctcgcgcggcctcgtccccgcagggtcgtccccggcggcggctggtgctctctctcttctgtcatcggccagaggcagcgtggcgggcgccagcgggccctggctggtcacggcggcgcgggaggacatcccggcgcgctccagcgcggcgctcgacgaccttatcgccgagaaccgcgccgccgcgctcctcgcgcggcagtacttcgtctccgaccgctcgccggcgcccagacgggatttcgtcgcctcttcgacggcgggttgctccctccagcagcagcagcacccgcccgaccacgaccacacagccggctggcacccgcacccccacccctacagtggcgttggcgttggcgttggcagcggtggtggccggtaccagtaccaccacgtggcgccgccgagcgcgtggcacacgacgaccctggatcttatgcagccgacagcaagcaccgccgccgctccctccaccgccggcgcagcgttgtggccagcagtgtcgccggagagggcgggcgcgaggtcgtctcgctctcgcagcaagaccaaggatggcgacgcgtcgggatgtagcggcttggacgcgtgggcgcccactggtggagctcgtgtgctgtgatcgccatgcaatcgacgagcgtgacggccattatatatgttgcgcctgtactggtcgggtgttgcgtggtgcctgatctgtcccaaaagggatgtgtaatccaatgtacttcgggatgtgctt

SEQ ID NO: 821 - DNA, 1533 bp, Zea mays
atgctcccctcttggctatttgtttgtttcttgcagaggaattttttcctgaacttgtcctcgccgtcttgaagcacacacgcgagcacgcgcccgcactgttcgctcgctccccatctccacacccgccgctctccacagtgctgctatcgagacgtctttctccgattgtttcttgtttgggagcaggcggaggcgtttctttccttcttcgccggcggcggcatggactgggcagcggcgtccgggtctccgtcgtggggcgcggcggcgacggaccccggtccgaccatgctgtccttcgcaggcccgtcctcctccgccgccgacgccgaggtgcggctccaggatttcgccgcgggtcttgcccagagctcgcggccgactggggcggcgccgggagccgggaggaggtcccgcgcggccgtgggaggtgccggcgcggaggcgtgctccgtcgacggctgccgctctgatctcagccggtgccgcgagtaccaccggcggcataaggtctgtgaggcacactccaaggcgccggtggtggtcgtcggcggacaggagcggcgcttctgccagcaatgcagccggtttcacatgctgtccgagtttgacgaggaaaaaagaagttgccggaagcgtctggatggccataataggcgtcgaagaaagccacagcatgatctgacaaatctagggggtttctttccataccaccaagtgaatcagtttgagttctacccacaaacaattccaacagttggccagaattcggacgccgtgcacttggtgggccgtcagcagcctttctccatatcgttctcaagaacaccagacgagttccctttcccacagggtggcggtagcagtgtgctgcaccacctccatgcagcccgccctggccatcacgctgaaggcagcagccacactggaagcagcacacgcgacaacgctctctccggcacactgggccccgagtgtgctctctctcttctgtcatcgtcgctgcgtcgcccctcaactgctggcgtccccgccgttggccaaccccaggttactgcctcttcgaccactgccgctgccgtgtcgcaggctgcaacggcagctgtggccactgctgcattcgcggccagtgctggccaccatgtgtttgttcctgatgctatgtttgaggatccatcacaggcactgccattctcttggcagtaggattgttttgttgtcctgtttttatgtgctcctgttgtgttctcgatcgatactctagtgtctgatggctgggaattcggggtacctgtgcacttgcagactcaggttgtggtccgtcagagatgtatacaagtgacacgacgactagtgctggcatctgaaaggaagtggtagctgctgtgcagagtgtttagccgttaaattcaaatgcgcccgttcaatttttttcttcgttttccttgtatatatgtgtttgtttttttttgggcaaaaatatgtgcatgttatgcacttctggaatcgtcgaatcaggctgcagtcttg

SEQ ID NO: 822 - DNA, 1380 bp, Zea mays
atgccggtttcctgggacctgcccgacctggagcacgacgccgtgccgccgcccatcgccgccgccgcctccgccgcgccttcccccgcggcggcgtcgggcattgccgccgcagctgctgggcctccccccgcggcggcaccgcgcggggcgccgagccgggcggagtgctccgtggacctcaagctcggcgggctcggcgagttcggggctgcggacgggacgaaggagccggtagtggcagcggccgcggccgcggccgcggcgccgccgtccgctagcccgatgaagcgcccgcgctcggggcccggtggcgccgccggggcgcagtgcccgtcgtgcgcggtggacggctgcaaggccgacctcagcaagtgtcgcgactaccaccgccgccacaaggtctgcgaggcgcactccaagacgcccgtcgtcgccgtcgccggccgcgagatgcgcttctgccagcagtgcagcaggtttcacttgctcgcggagtttgacgaggccaagcgcagctgtagaaagaggctcgatgggcacaaccggcgtcgcaggaagccgcagccagataccatgagctctgggagctttatgacgagtcaacaagggacgaggttctcgtcgttcccggttccaaggccggagccgagctggcccggagtcatcaaatccgaggacagcggctcatactacgcgcaccagcgccacccggtcctaagcagcaggccgcacttcgccggcgggggctccacgccgccggcctactcgtccaaggaaggccggcgcttcccgttcctccaggacggctgcgaccagcagcaggtcggcggcttcagcgcgggcgcgggggcgcagcagctcgaggtctcttccacgtccacggtgtgccagcccctcctcaaggccgccgccgccgccgccccaccgccgccgccagagagcagcagcagcaacaagatgttctccgacgggctcgcccccgccgtgctcgactcggattgtgctctctctcttctgtcatcccccgccaactcctccagcgtcgacgtgggccggatggtcgtccaccagcccgcggagcacatccccatggcgcagcccctcgtccccggcggcctccagcagcagcagcagcaccacccgttcggcggctcccccgcctggttcgcctgctcccaggccggctccagcgccgtctccgccggcggtttcgcctgccccccgggcgtggagagcgagcagctcaacaccgtgctggtgccgagctccgacggtggcggccacgacatgaacatgaactaccacggcatattccacgtcggcggcgacggctcctccgacgggacgtccccttcgctcccgttctcgtggcagtag

SEQ ID NO: 823 - DNA, 1284 bp, Zea mays
gcacgagaccattacctagaacatcctaatcgaaaaactttgaatttgagttgtttattacgggcattacgcattaccctggagtgtggactttgttcataagattatcccggctcctgagagattcgttctatctgattttccttggaattttcgtgatcttggtttcacttgctcctagagtttgatgaggccaagcgcagttgtagaaagaggcttgacgggcacaaccggcgccgcaggaagccgcagccagataccatgagctctgggagctttatgacaagtcaacaagggacaaggttatcgtcgttcccggcaccaaggccggagccaagctggtctggagtcatcaaatccgaggacagctcatactacacacaccacccggtgctcagcaacaggccgcacttcgccggcacctccacgtcgccggcctactccaaggaaggccggcgcttcccgttcctccaggacggcgaccaagtcagcttcagcgcatcaggcgccgggacgctcgaggtctccacggtgtgccagcccctcctcaagacgaccgccgccatggccccgccgccgcccgagagcagcaagatgctcgcccccgtgctcgactcggattgtgctctctctcttctgtcatcccccgccaactcttccagcgtcgacgtgagccgaatggtccagcccgcggagcgcatccccatggcgcagcccctcgtccccggcctccagcaccaccagttcggcggctccccggtgccggactggttcgcctgctcccaggccggctccggcgccgtccctgccgcgggcaccggcgggttcgcctgcccccacagcgtggagagcgagcagttcaacacagtcctagtgccgagctccgacggcggccacgagatgaactaccacggcatattccacgtcggcggcgagggctcctccgacgggacgtccccttcgctcccgttctcgtggcagtagcttaccgttgaagcgggcagtgttatgatcggtcagctgtagcggtggtcatcacaccagttccctcttctttccgtgtttatttattctctgctccctcacgcactcccccgtgtcacttgctagtttcttagttttgcatgcctgatgcatgtagcctgaaaaaactctatcaaattagtgccagatttcctagttcccgtttgtttcattttattttgagaattggaatcttactaatgtaattgactatttttttagaatatgacattccaccactttacaaaaaaaaaaaaaaaa

SEQ ID NO: 824 - DNA, 1308 bp, Zea mays
accagcgtacgaagtcgccggcctgcttgggttgagtcccgaggagagagctgctactccctgtgcaaggatcccgacaacaggcaggcacgtacacgcgcgtcggcctggggacgggctgtcgccatggactgggacgccaagatgcttcctgcctgggacctcggcacggtggtcgggcccagcagcagcgggggcggcgcgctggacctgaagctgggcgcgccgacgagctcgagggcggtgctcacggccgccgccggtgccgcgcccgcgctgccgtcagcgaaccctcctccgcccccgcctccgccgtcgtcgtccgcgccggcgaagcggccgcgcccggggctcgcgcggcaggcggtgcccgcgtgctccgtgcagggctgcgacgccgacctgtcccggtgccgcgactaccaccgccgccacaaggtctgcgaggcgcactccaagacgcccgtcgtcaccgtcgccggccagcagcagcgcttctgccagcagtgcagcaggtttcatctgctcggggagttcgatgaggtgaagcggagctgcaggaagcgcctcgatggacacaaccgccgccgccggaagccgcagccggaccctctcaaccccgccggcttgtttggcaatcaccacggagtgacaagattcacgtcttacccgcagctcttcgcggcgtccatggaacagcctaaatggtcggtggtcaagacggaggccgacgtgttccaagaccagtactacccggccgtccacctcaatggcgctggcggcggcgccatcggctcccacttccacggcaaggagcggaagcacttcccgttcctgaccagccacagcaacggcggcggcggcggcgacgtggcgaccgccgcggccctgggctgccagccattcaccatcaccaccacggcggcctcagagagcgacagcaagcagagcaacggcaactgtgctctctctcttctgtcagacaacccgacatcagcacagacggtcatgatccctactaccgcgcagtccctcgccgcggtgatgcagcacgggggcagactccctggcagcgtcagcgctcagcggcgataacagatgctgcttgcagccttggatatttgtggagtgaacgcattgttgatagcatatggataagaaagtaatgtaattatctggagatgtgtaattatgtggcaatattatttgcaacaatgatgcatggagtactttcatgtatgatactgaggctttgcatttgatttgcttctatttggaaattatagtaaagcgtcgagcatacatatt

SEQ ID NO: 825 - DNA, 1698 bp, Zea mays
caccagacacgccaaaagcgttattttaagggcggcgccaccactattgtcgcctgcttcaccctccctgctcactgccgcctaccctcgttgaagcgcgctctctcgctctcgctctcctcgcgcttcctcccactcccactggacagagaggagggttagtggagggcggggtaggaagctaccgccgccacagtaacagcgttagctaggggggaagcacggaagcgggaagcaatggcgaccggcggcggcagcagcaggagcgacgacgtgcgcgggctcaagtttggcaagaagatctacttcgagcaggacggcgggagcgggagcggggcgggggcggtgggcggcaggaaggggaagggcgtggccaccggtggcgcgaggccggcgtccgccgcctccgcagcccagccgccgaggtgccaggtggacgggtgcggcgtggatctgagcgccgtcaagcagtactactgccggcacaaggtgtgcaacatgcactccaaggagccgcgcgtcttcgtcgccggcatcgagcagcgcttctgccaacagtgcagcaggttccaccagctacatgaatttgaccaagggaaacgtagctgccgccgccgcctcatcggtcacaacgagcgccggaggaagccaccacctggacctctcacttcacgatatggccggctcgctgcatcacttcaagagcctggcaggttcagaagcttcctgctcgacttctcgtacccaagggttccaagcagcgtgagggatgcgtggccaggaatccagcacggtggcgacaggatgctgggcaccgtccagtggcatgggcaccaagaacctcctcacccacaccgcagtgcagctgctggctatggcaaccatgctgcatacaactgccatggcggcttggtagcaggcggggccccaatgctctcctctgccgcctttgagctcccgcctggcggatgtgtcgcgggagttgccgccgactccagctgtgctctctctcttctgtcaactcagccatgggacacgacctcccacgaccaccggtccccagcaatgcccgcggccggcgccttcgacggcaccccggtggcgccgtccgtcatggcgagcagctacgcggcgtcgagcgcctggacgggctcgcgggaccccgctgccgacggcgccaggaacgcgcagcgtctcgacgatgctctgcacctggtccacccaggctccgcggcggtccacttctccggcgagctcgagctcgccctgcagggaagcggcgggccgccacacctgccgcgcgtcgaccatggcggctccggcggcggcaccttcaaccattccaccaccagcgcgatgaactggtccctgtagcagcactgcctgccttcatccggtcgccacgccacgagatgtggagggagcacttttgcattggacaccaccctggttttgtgcgccttaccttgccgttctcgttttttcagggtggagaaactgggattcctaaccatagtagatctaccgtgaattcccttcccgtgtagtagcgcattgcgtccatgaactcatttgatcgatcgtcgtgtcaccgtgtgcgtaactgcgtatctgtttggcgtaaatgagtatctgtttgttgaatctttccgaacattgcggacttcccatgctgcttcaagcaacaactcgggctat

SEQ ID NO: 826 - DNA, 2254 bp, Zea mays
atagaatgcaactttcattacttataaaaattctgttgctgggccaccaacttacattacctgtaataaactgggatcacgggcgcgtgaataaacacacctcggtttgtcgacgctccctcatacctaccagccaaaccaagcaagcagggaatccccacaaggcagcagatggaagcgaaaggtggcggtggcgcggcgtggcgcgggcgcgggcgcggctagctaggccggctcgtgtgcgtgcgcgaggagacagccacagccatacagggatgctgcctgcttcgtgaccgtgctggtggtggtgggctgcagcctgcagctcgtatcacacgcccacagtgcaggaaggagggagtggaagaagagagaggaagttgtttttaaaggcaacagcgagtcccgctgctgtccctctccttcgccacctccctccctcactctcttccctccctctcggaggaggagagagaagagagggagccagtccagctccagccagccggacgcccggaccaacaccaccccgcctccccctccccccgccccaccggcccgccctctcgcgctgccgtacccacggccccacgcacgttcacaagtctcgtcgccgccgcaatggagtccggcggtggcggggacgaccagctgcacggcctcaagttcggcaagaagatctacttcgaggacgccgccggctccagcagcggcagcagcagcggcggtggcagcgcgcccgcgcctccagcgacgcagcagccgtcgccgccggccgcttcgcctagggccccggccggcggcggcaggaggggcagggccgcggccggcggcgcgggcccctcgacggcgcccgcgcccgcccgctgccaggtcgacggctgcaacgttgacctcaccgacgtcaagcccgcctactactgccgccacaaggtgtgcaaaatgcactccaaggagccccgcgtcctcgtcaacggcctcgagcagcgcttctgccagcagtgcagcaggttccaccagctgcctgaattcgaccagctaaagaagagctgccgcaaacgcctcgcaggccacaacgagcgccggaggaggccgccgcctggaccccttgcgtcacgatacggccgtcacgctgcgtcgctcggcgagcccggcaggctcagaagcttcatgctggatttctcgtacccgagggtctcaagcgccatgaggggtgggtttccggcggtgaggcccggtggtgaaagggtgcctggcggtatccagtggcaagcgggcttggatcctcgtcaccaccaaggcgcggtcgcgggatacggcgcccactatgggagcgagggtggtagctcgtcgtcggcgaggccgccggtgttccctggcccggagctgcccccaggtggatgccttgcaggagtccccgcggactccagctgtgctctctctcttctgtcaactcagccatgggatgctgcccacagccacagccacagccacgctgcgccaacagcgggtttcgacggcggcagccctgtggcgccctccctcatggcggcgagtagctacatcgcgccgagcccctggaccgagaccgactcctggggccacgaaggcgggcggagcgtgcctcagctgccacctgacgacgtccccctcggcgaggtgcactccggctcgagcagccaccacggccagttctcaggtgagctcgagctcgccctgcagggaaacaggccagcgccagggtcggcggcaccgccagcgccgcgcaataatcagggctccgcgggcacgttcgaccaggctggcaacacgatggactggtcgctctaggccgggggccgaaataaagcgcagcagatcctagccgcgcagggagatggaggaggctgaaagtctgatgctgcacgctgcttgcttagcttagagcatccagcatgataagagtgatgaactgatgcggtgtcaggagactagtttattctgtgcttcaccatgaactcgtctgtcgcggcgtctatgtagacagacggcacggcagacgtccgtggttcgaagttaccagtatgcttgtcggggactttgctcgcgatgcattaaaaaaaaaaaaaaaaaaaaaaaaaaaaaaaaaaaaaaaaaaaaaaaaaaaaaaaaaaaaaaaaaaaaaaaaaaaaaaaaaaaaaaaacaacaaggagaaaaaaaaaaaaacaaaacccaaatttcttgaaaaaaaggaaaccctaaaaagaggcgaaa

SEQ ID NO: 827 - DNA, 1838 bp, Zea mays
gtgcaggagggagtggaagagagtagagagagagtgggagcgagagcacagggaggggagttgttttgaaggcaacagcgagccctgctgtccctctgcttcgccacctcctccctccctctctttccttcctcttggaggagagagaagagggggagagccagtcagccagccagcccaagaacagcgtacgtacgttgtcaagtcccgtcgccgccgcagcagcttcgctcctcccgccccgcccaccgtcgcgcgcggcggcggggagcgagcaatggaggccggcggcgccagcggcggcgacgaaggggacggccagctgcacggcctcaagttcggcaagaagatctacttcgaggacgccggcggctccagtagcagcggcggcagtggcagtgccagcgcgaccgcgcctccagcgacgcagcagccgtcgccgccggccgcttcgcctagggccgcgcccggtggcggcaggaggggcagggccgcggctggcggcgcgggcccctccttgccgcccgcgcccccgcgctgcctggtcgacggctgcaacgccgacctcaccgacgccaagacctactactgccgccacaaggtgtgcgaaatgcactccaaggagccccgcgtcgtcgtcaacggtctcgagctacgcttctgccagcagtgcagcaggttccacaacctggccgaatttgaccagcaaaagaaaagctgtcgcaagcgtctagcaggccacaacgaacgccggagacggccacctcctggaccccttgcgtcacgatatggccgtctcgctgcaccgctcggtgaagagcccggcggcaggttcagaagcttcatgctggatttctcatacccaagggttccaagcgccatgagggatgggtttccagcggttcgacctggtggtgaaagggtgcctggcagcaatatccagtggcaagcagcgagcctagatcctcctccccctcaccatcagagcgcggcagcaggatacggtgcccactcgtacgggagcccgggtagctcgtcgtcgtcgaggccaccggtgttccctgctggcccggagctccccccaggcggtggatgtctcgcaggagtccccacggactctagctgtgctctctctcttctgtcaactcagccatgggacgctgctggccacagcgccggccacggccacggccacgccgcgtcactgcccgcaacagcaggcttcgacggcaaccccgtggccatggcgagtagctacatcgcgccgccaagcccctggaccgactcccgggcccacgaaggcgggcggcggaacgtgcctcaactgccacccgacgtccccctcggcgacgtgcactctggcccaggcacccatcacggccagttctcaggtgagctcgagcttgccctgcagggaaacaggccagccccggcgccgcgcaatggccagggctccgcgggcgcgttcgaccaggccggcagcacgacggagtggtcgctctaggaggccaaataaaagcgcggcacatcgtcgtagccgcacagcgagatggagcttgaagcctggctccgctagctacctgcatgcgctgtttgcttgcctagaggctagagcatccagtatgataataagcgaggaactagtgcagtgccggccaggagactgatttcttttgcgcttgtccatgaactcgtctgttgcgtctatgtacacctccatggtttgaactcgtcggggacttcgctcgatgtgttattaatctcatgctcatccttccgctaatgttgcctggcggcatcgccaggaatcggttccaaggctaaaaaaaaaaagaaaa

SEQ ID NO: 828 - DNA, 1587 bp, Zea mays
cagagctccagctccacatcgccagctgccgggccgcacctcgatcgcccaggccggcggcggcgtctgtcgttgcggcaggcggcggcggcgggccgaggtgccaggcggagcggtgcaacgcgaacctgatgaccgaggagaagccgtacaaccggaggcacaaggtgtgcgaggcgcactccaaggcccccgtcgtgctcgtcgccggcctccgccagcgcttctgccagcaatgcagccggttccacgagctgtcggagttcaactacttcctccaatctcccactcattactcagcttaggaaggtccagggcctccagctccgatccaccacgctacgctagctctatgccggactcctcctcctccgccggcacaggcggcatggccccctcgagctcggcggcggcgtccattgccgcgctcgcggccgccgcggcgtccggcgacggctcggacgactccggggcggccaacaacaacggcgcgctgccgctgccgctgccgccgccgcacggggtggaggacaacaacagtcccgcggagctggcgggcgcgggtggcacctcccgggcggtggcgaggagggtcgcggcggccggcgcctccccggcggcggcggcgaggaggggcgccgccttgaacgccgcggcggccggcggcgccgggccgagctgccaggtcgagcggtgcagcgccgacatgggcgtggagaagcggtacaaccggaggcacaaggtgtgcgacgcgcaccgcaaggcgtccgtcgtcctcctggccggcctccgccagcgcttctgccagcaatgcagccggttccacgagctgtcgcacttcgacgacaccaagcgcagctgccgcctgcgcctggcggggcacaacgagcggcgccggaggaaccccgcggaggcgcaggaccagcacggcgggcggggcgacccggggagccaccacctccagatcagataaaaacctactacgtcagcatgctctctctcttctgtcatgcaggacgcacgcacctagcgtcgtcaccgatccatagtccgatatgtgtctcaagtgttgtgtgtgcgcgctctcgccgcctacccctgtcctgcagtgttgcgtagtatatggttctacgacctacacgtactgctgctactactgcgtgctaactttaatctgatggcagtccacagctagctagcacatcacctcctgtaagtaatgtgcttatctatatgtgcaccgacccggaaccggaggcgtgcgtacgctgatctgccacgaagcctactagtagttaaatgtaacgtaacctgcaggcaattaagcagggcgctgctatatatagcgtaattaattgtgcgtatgggtatggtggttcgattatcggatgtgtaatccctgtacgtggccgggcccgtgccaaacgtacggtgacctgtgcaggctctgtgtgtcgatgatgttgtactctgataatgatataatccattgtggtaatgtatgctattaaaaaaaaaaaaaaaaaaaatgtactgtgtgctgggcggccatcccgggaattccggacgcggtaccagccctgcttt

SEQ ID NO: 829 - DNA, 1003 bp, Zea mays
actcattactcagcttagaaggtccagggcctccagctccgatccaccacgctacgctagctctatgccggactcctcctcctccgcctccccggcggcggcggcgaggaggggcgccgccgtgaacgcccaggcggccggcggcgccgggccgagctgccaggtggagcggtgcagcgccgacatgggcgtggagaagcggtacaaccggaggcacaaggtgtgcgacgcgcaccgcaaggcgtccgtcgtcctcctcgccggcctccgccagcgcttctgccagcaatgcagccggttccacgagctgtcgcacttcgacgacaccaagcgcagctgccgcctgcgcctggcggggcacaacgagcggcgccggaggaacccggcggaggcgcaggaccagcacggcgggcggggcgacccggggagccaccacctccagatcagataaaaacctactacgtcagcatgctctctctcttctgtcatgcaggacgcacgcacctagcgtcgtcaccgatccatagtccgatatgtgtctcaagtgttgtgtgtgcgcgctctcgccgcctacccctgtcctgcagtgttgcgtagtatatggttctacgacctacacgtactgctgctgctgcgtgctaactttagtttgatggcagtccacagctagctagtactgtgcttatctctatgtgcaccgaccggaaccggaggcgtgcgtacctacgctgatctgccacgaagcctactagtagttaaatgcaacgtaacctgcaggcaattaagcagggcgctgctatatatagcgtaattaattgtgcgtatgggtatggtggttcgattatcggatgtgtaatccctgtacgtggccgggcccgtgccaaacgtacggtgacctgtgcaggctctgtgtgtcgatgatgttgtactctgataatgatataatccattgtggtaatgtatgctatttaaaaaaaaaaaaaaaaaaaaaaggcggcgctcg

SEQ ID NO: 830 - DNA, 2856 bp, Zea mays
gccggccggtttgggacgtccacctgttcacttcctgccccctccccgcacctccctccgatcccccaaatcccgaattgaccaacccaaagccgtcgccccgcatggagtggacggtcccgaagcgcgccagggccgacgacggcgaggtgaggtgccaggtggaggggtgcgggctggacctcagcagggtcaaggagtaccaccggaagcaccgcgtctgcgaggcccacaccaagtccccccgcgtcgtcgtcgccggtcaggagcgacgcttctgccagcagtgcagccgatttcatgccctgtcagagtttgatcagaagaagaggagctgcaggaggcgtctgtctgatcacaatgcccgccgccggaagcctcagccagatgcattcgcctttgcctctgcaaggctgccttcgttcggtaatgtgttcatatcttaagtagtgcttgaaatttgccagtggatactggcaaaatggtggtgatgggctcttagccagctgcatgtacagcacgccaatagatgtcttgttgctcaaatggcaagctttctatcttttatacttggcaataagttgctgttgcgtttcttcatggaattatatacaaactaaactagacattttttgaccggcaaaagctgtaggggaaagcaataaatatactccctccgttctttttttatttgtcgcgttttagttcaaaaatagtattattttaaaagaaagagaacttttgtaccgagaggggtgaaaccaccaaagggcagagaaataaaagaagtaaggagaaaagaagaaagagagggggggggggggcgtagagagaacttagccataaggatatttgcagtttgagatcctggctaaatctatacatctgaagcttcagcgtgttgttgaagcagactttccaggacgaaaacgaaggggcctcctcctgaaagataaaagcatttctttgtttccagatttcccaagctgctatttgcacaacaagtttagtaatatgataggaggcaaataagttttgtctggaataaagctcctgttagccatgtaaggcctttcacttctccatgggacagctcatctgagctccctcatgcaaaggaaataagagaggtgtcaacgaaagttgggacaattactggacaggttcatttggataaatcttacgtgtccaacgctattccatcacttacccatggcaaagatgagccttggccaatgaaaggtctggtaccccgtctcttcttctgcacagtccacactgttcacttccggccccctcccccgcacctccctccgatcccccaaatcccgaattgaccaacccaaagccgtcgccccgcatggagtggacggtcccgaagcgcgccgcctcgccgccctcgcctccgctcctctgggactgggggggagaccacgccggcgccacgggctcgggctcgggctcctccggcgacgccccggcgcggcgcggcgggagggagcgggaggcgaagcgcgccagggccgacgacggcgaggtgaggtgccaggtggaggggtgcgggctggacctcagcagggtcaaggagtaccaccggaagcaccgcgtctgcgaggcccacaccaagtccccccgcgtcgtcgtcgccggtcaggagcgacgcttctgccagcagtgcagccgatttcatgccctgtcagagtttgatcagaagaagaggagctgcaggaggcgtctgtctgatcacaatgcccgccgccggaagcctcagccagatgcattcgcctttgcctctgcaaggctgccttcgtcgtcgttcgatgataggaggcaaataagttttgtctggaataaagctcctgttagccatcctttcacttctccatgggacagctcatctgagctccctcatgcaaaggaaataagagaggtgtcaacgaaagttgggacaattactggacaagttcatttggataaatcttacgtgtccaatgctgttccatcacttacccatggcaaagatgagccttggccaatgaaaggtccggacatgtctatagctgcttcaaaattcgatggagcaccggatcttcagcgtgctctctctcttctgtcagttggcgcctgcggattgcccgatcctgtacaccaaacatcttgcgtcatccaattcactagtgccagcgagaacagtggcgaccttcatctatcacatggagcgaactctggtctagcgtcatgcggtgatggacagcatatagcttctcagcctcaggctcagctggttcggtttaccatggataccagcaacagtgtctatgagcccagtttcttcagtgtaaaccagataaattaagcgttgaagacacacgccacttggtcatttggataaatagccctgaagatggcctgagcttgtgcaagaagttcttcaaccaaccaccggacataaggatctatctgttaatgttatctgtgtatttattagccatacctgaattaagttgaacccaatctaggccagcttatgtgcaatatgcagttccaacctgtgattgacccattttttctgttgtttctttgcccgtgatgtgactgctctggaacttaagtgtgatactgttgtagttacactttactgccctgacaatcatgtcaaacggctggatatctttgaaactgtccttgatgaatctggacgtgtattttgtgtgtatatatggtctgttgcttcaatactgccatcattaaaatatttgaaggacttcagctaaaaaaaaaaaaaaaaaaaaaaaaaaaaaaaaaaagggcggccgctctagagtatccctcgaggggcccgaagcttacgcgtac

SEQ ID NO: 831 - DNA, 2113 bp, Zea mays
acaggcgggagcgcggacggtggcggaccgtggtgggtttgtgaggcgttggctcccttccccactgcttcctccccccactgccggtcgctgtgcaagagctgccacgagacagcagattccccatcatccaaagcgaggtgagattcttgctgaaagatcggacggagggagtagaatcgcggggggcgtggctgtggttgccagtcgccatgccatgatgtgtgtagggtccagccaccggagaccggagttgctgatgacgacttggcgatgctgtggtttccaggctaacaagtttgtacaaaaaagcaggctggtaccggtccggaattcccgggatccccactgccggtcgctgtgcaagagctgccacgagacagcagattccccatcatccaaagcgagcgaggtagctgcttgggcagacaagtaggagcagcggctcaaacttcggatctcggcatgggctcctttgggatggactggaaccagaaggcctccgtgttgtgggactgggagaacttgccgcccgtagccgtaggcgcgagcgggagcgagaaccccaggatggctgctgcgcctcaggctttgcattctgcctgtggcaccatctcttccagctcagagatggggtatggctcatccaagagctccgtatccgcgtcggctgatgattcttcacccaaggccaaggggaaaagcatggagctcaacttcgcacctgacaaagtgcctgacaagaacactgattcagggaaggttgacgacgccaggacctctccgtcgtcgccggtgattgccatcagcagtgcagagcccgtgcttagcctgaagcttggcaagagaacgtatttcgaagatgtctgtggagggcagagcgtcaagagtttgccgtcggatacgagtgcagtgactcctcctcctgcttctccgaagaagacgaaggtgactccaaacaagaaatcttactgtcaggttgaaggctgcaaggttgatctctcttctgctaaagagtaccatcggaagcacagagtctgtgaacctcattctaaggctcccaaggtggttgttgctggtctggagcggcgcttttgtcaacagtgtagccggttccatggattagctgagtttgaccagaagaagaaaagctgccgcaggcgcctcaatgatcacaatgcccgcagacggaaaccacaacctgaagcactttcttttgggtcatcaaggctgtcggcaatgttctatgacacaagacaacacacaagccttctgtttggtcaaggtccttatggtcaaatgagaagttgtgcaagttcttcatgggataacccaggaggcggcttcaaatttgcagagacaaaaggtccctggttaagagctggtggtgttgatgggttgcatcaatcaagtcagcaggtgtggaacaactttatgccgcatggtgtccatcaagattttgatgggttcacagctttcaaaggaaccaatgcaaaggtccttcatcaaggcgttgaagcttctgcggtcgcctccaaccagaacggagccccacaaccggaccttcatcgtgctctctctcttctgtcaaacagctgggctggtgccggtaccgaccagcacccgacggcccagctgcgccaccacgctgccctgagcagcagcctcgccgccagctccgtctccgtggcgcaggcctcgccagcagggctgtggcaggacggcggcggcggcgcaaccctgagccaccacgactatgcccacgcgcaggcacggttccaggctatcgacgcgctgggcggcgccggcgccgccgccgttgcagcgggtcaggagcttctccagctcccgcgtccgccgtccccgtacgatggtggctcctcgtcccgctacgacctgatgcgctgatccttcttctcccttggggcttctggtggagcgcggggtttcgatttttgaacgaactctggatggaactcggagttttgaacgaactgctgtatgcttgctatcaaggtctgctggctcgggctcggacgctcgtgggatcgccagcagctccgtgtgcttgaataaatccacagttttttttgtgtgacgctagctatttatt

SEQ ID NO: 832 - DNA, 1983 bp, Zea mays
tacaaaaaagcaggctggtaccggtccggaattcccgggatgtcgataattgggggagtcttgtcttcctcatctgctcccctttcctcgccgctctgcctcgccttttgggtttctgagaggcgctgcgctggtttgccttccccactgctcgctctgccggtcgccgccgtggaagagctacaccacgacgagacacaggttctctcgacccgtcatcacccacagcgaggctgagcggagaggagacgaagagaggaacagggtacacagatctcaagaagctccatgagggcgaacctgtgccccggcgcgcgaggctgagcttcttgcacgctgcgcccaccccgagctcgccgatgcgccgccgccgcagcagccgcagccacggctgtccagccggcgtgctgacctgacgcggactgacctagacgcaggttgccctgtccgttcccttttttttctgagttagccgcttcggcaggcaagtaggacgaggagcagcagctcagatttcggatcctggcactggcaactggcatgggctcgtttgggatggacatggactggaaccagaaggcctccgtgctgctgtgggactgggagaacctgccgcccgcagccgcaaacgggagcgagagccacaggacgaccgctgccgcgcctcagttcgcgggccttgaggccacagggcatgaaccggcgccttcttccgtatcctcgtcaatccattctctgcccagtgccaaggggaacaagaacaagaacaacatggagctcatcagtttcgcacctgccaaagcgcccgacaaggacactggttcggtgctcagcagcggagagccggtggtgctaggcctgaagcttggcaagagaacgtatttcgaagatggttgtggactagggcagagcggcaagagttcggcggcgttaggcactgccagtgcagcgacccctccgggtcctgcgaagaaggcgaaggcggcggcggcggctccaaccgcgcagcagcagaaatcgtactgccaggttgaaggctgcaggaccgatctgtcctctgctaaagactatcatcgcaagcacagagtctgcgagccccattccaaggcgcccaaggtggtcgtcgctggcctggagcggcgcttctgccagcagtgcagccggttccatggactggccgagttcgaccagaagaagaagagctgccgcaggcgactcaacgaccacaacgcgcgcaggcggaagccccagcccgaagcgctccctttcggctcatcgaggctgtcggcgatgttctatgacacgaggcgccaggcgagcctcctgtttggtgaaagtccctacggtcagatgagaagctgtgcgagttcttggtgggatagcccaggagcaggaggaggaggcttcaaattcgcggagacgagaggagctccttggttgaagccggcgagagctgctgctgatgggctgctgcctttgtcaggtcagcagcagcagcaggtgtggaatgactcgattccgcatgttgcccatcaggaggatttcgatgggttcacggtcacggcgttcaaaggaatcagtccaaagacccttgatcatcaaggcgttgaagcctgtgcggccgtctccagcccggacggcgccccggaccttcagcgtgctctctctcttctgtcaaacagtccggccggtggcggcggcaccaacaccaaccacccgccgccgccgccggcggctgagctgcaccaccaccgcgctgccccgagcagctgcctcgccgccggctccgtctccgtgctgcaggaggcctcgtcgccggggctgtggcaggacggcggcggcagcgcggccctgggccaccacgcgcacgcgcggctccaggctctcgacgccgccatggcgacggcgcaggagctcctccagctccccaggccgccgccatcgtacggcggctcctcgtcccactacgacctgatgcgctga

SEQ ID NO: 833 - DNA, 1986 bp, Zea mays
gtgctgaggtaattgctgcgaaagatgagagagggtcttggatgtgggtggttgtgatggtggagcacgagaccattacctagaacatcctaatcgaaaagaggatagggaaggcatgcatgatagggacttcaaagacccaggtgagagctcagtcgacggtaatgccgccgcagctcctttagtcgccaggcgattggcatgccacggttcctggttcatctcgcagagttagtttgagttcgaggcttgtgtggtgttgctgattgcgcacaagaggtccaggaacatataggcggcggatctggctgcgttctttctgtttcgtcagagaaggggtttcagcgctgccagctttcacataaacaagttggggaagcagttgaggttttctaattcttcttggaaggattgagatctccagttctgataatgggttcttttgggatgaactggaatcagaaggaccccatggtgtgggattgggaacatctagtaccgtctgtctcaaatgcagttacaaggcacggatctgctaattcatctggtggtactcttacttctaactcagagctagggcatggttcatccaagagctctatttcagcgtccattgattcaccctctggagtagggaacagcttagagttcaacttcgccgctgttgagaggcatgttaagaacacgggcacgaacggcagagtcgatgactcggggaattctccatcgtcaatgatagctttcaaccaaggagagccattaatcagcctgaaacttgggaagagggcttacttcgaaaacgcctgcggaggacaggatgccaaggtttctgcagcttcagacgttacttctgcagccagcgtggtcaagaagactaaggtgtctcagcagaatgcaaagaactggtactgtcaggttgaagggtgcaaagttgacctgtcttctgctaaagattacaatcgcaagcacaaggtctgtgtagtccattctaaagctaccaaggtggttgttgctggtctagagcgtcggttttgtcaacagtgtagccgttttcatggtttagcggagtttgatcagaacaaacgaagctgtcgtaggcgtctgatgcatcataatgcacggaggaggaaacctcaggcagacacaatttcattcaattcatcgacaatgttttatgatacaaggcagcggacaaatcttttctttagtcaaccactttatggccaagtgaggagcaatgcagggtcttcatgggataacttgggaggcttaaaattcatggagacgaaacatccgccagtgcatccaacaaaaacagcatcccctgatgaactgcatttctcagccctccagataactagtgctgcggctcacaccgggacatcatcatgatctcgatgggttcatggcgttcaagggaaccagcacaaaggtccttaaccaaggcgtggaggcttgggcggccgcttccagctcgaacaacggaggcccagaaggtgggcgtgctctctctcttctgtcagacggctcgtggggctcgagttcagccgtcatccagcagcccacatctcacgcggacgccggtgcattgctgccgcccctcgccaccgttgccgtctccaacgccgccgccgccgccgggcatcctctggacccgtccccggggaaggttctggccgcaagacgatcatcccccgctcgtcgacggacccgccacgcagattccggagctggcgcacctccggatatggtgaaaggaaacgcatgtgatgcggtgactggtgacatgccagttcgagggcctggctgggaacacatctggttggttagcctgccgctctggcttgaatttgccggcgacgacagtctttgtttgtatcttttgatcagaacggacacagacatgtttgcgcaatataatgtgacgagtccctctggggttgaggagtgaggagatggagaacgataggaggcaaaaaatatata

SEQ ID NO: 834 - DNA, 2354 bp, Zea mays
cgacccacccgtgcggtatttgccaagttacttttttttggcatctttaatgatttaggtagctttgaaaatgtgaccagctgagggcagggccagccactcaagttgtagagcgaagtggacttgtgctagtctatatgatgctcaattattttgcttggctcagactctcatgatatttatgttatttaatcttttctaattaaggtacacaggaacgctagcatgaaatgaatagtgaagaaaaattggcaattccttttgtttctggcactagctgtaatggtgtaggactgcctaagtggagtgttgaactgttgatgcaacatcttgagaaggagaaattgtacacaagcttataactaacatttacacttgatctagttgacataatgaagctatccctcttttctttaatccttctctgtttgtagttctttgggatctccaatagaggagaaaggttgccatctcgtgtgtgtgtgtctgttggatggatctctgtgagccatgccctctttgtcttcttgcttttgctttcttggtcccttcccttctcttttctagcagagctctcgtggttcttggccttccgtgtgtctgccaggtagaaattttaaccgaaaaaaagattcttccgagcaaaggagcgctgccagctttcacataaacaagttggggaagcagttgaggttttctaattcttcttggaaggattgagatctccagttctgataatgggttcttttgggatgaactggaatcagaaggaccccatggtgtgggattgggaacatctagtaccgtctgtctcaaatgcagttacaaggcacggatctgctaattcatctggtggtactcttacttctaactcagagctagggcatggttcatccaagagctctatttcagcgtccattgattcaccctctggagtagggaacagcttagagttcaacttcgccgctgttgagaggcatgttaagaacacgggcacgaacggcagagtcgatgactcggggaattctccatcgtcaatgatagctttcaaccaaggagagccattaatcagcctgaaacttgggaagagggcttacttcgaaaacgcctgcggaggacaggatgccaaggtttctgcagcttcagacgttacttctgcagccagcgtggtcaagaagactaaggtgtctcagcagaatgcaaagaactggtactgtcaggttgaagggtgcaaagttgacctgtcttctgctaaagattacaatcgcaagcacaaggtctgtgtagtccattctaaagctaccaaggtggttgttgctggtctagagcgtcggttttgtcaacagtgtagccgttttcatggtttagcggagtttgatcagaacaaacgaagctgtcgtaggcgtctgatgcatcataatgcacggaggaggaaacctcaggcagacacaatttcattcaattcatcgacaatgttttatgatacaaggcagcggacaaatcttttctttagtcaaccactttatggccaagtgaggagcaatgcagggtcttcatgggataacttgggaggcttaaaattcatggagacgaaacatccgccagtgcatccaacaaaaacagcatcccctgatgaactgcatttctcagccctccagataactagtgctgcggctcacaccggacatcatcatgatctcgatgggttcatggcgttcaagggaaccagcacaaaggtccttaaccaaggcgtggaggcttgggcggccgcttccagctcgaacaacggaggcccagaaggtgggcgtgctctctctcttctgtcagacggctcgtggggctcgagttcagccgtcatccagcagcccacatctcacgcggacgccggtgcattgctgccgcccctcgccaccgttgccgtctccaacgccgccgccgccgccgggcatcctctggacccgtccccgggaaggttctggccgcaagacgatcatcccccgctcgtcgacggacccgccacgcagattccggagctggcgcacctccggatatggtgaaaggaaacgcatgtgatgcggtgactggtgacatgccagttcgagggcctggctgggaacacatctggttggttagcctgccgctctggcttgaatttgccggcgacgacagtctttgtttgtatcttttgatcagaacggacacagacatgtttgcacaatataatgtgacgagtccctctttggggttgaggagttaaaaaaaaaaaaaaaaaggagatggagaacgataggaggcaaaaaaaatatatatttgtttcgcgcgttttcccggaagtatttaaaatatttaggatc

SEQ ID NO: 835 - DNA, 1610 bp, Zea mays
tatagaacaagtttgtacaaaaaagcaggctggtaccggtccggaattcccgggaccatctcgtcttctccacagtccacactgttcaccacctctcccatcctctcttcgatccccaaatcccgaattgaccagcccaaatcgtcgccgcggcgcatggagtggacggccccgaagcccgcctcatcgcctcccctcctctgggactggggagaccacgccgccacgggctcgggctcctccagcgacgccccggcgcggcgcggcgggaaggagcgggaggcgaagcgtgccagggccggcgaggaccgcgggggaggtgagctgaggtgccaggtcgaggggtgcggattggacctcagcagggtcaaggactaccaccgtaagcaccgcgtctgcgaggcccacaccaagtccccccgcgtcatcgtcgccggccaggagcgccggttctgccagcagtgcagccgattccatgcgctgtcagagtttgatcagaagaagaggagctgcaggaggcgtctgtctgatcacaatgcccgccgccggaagcctcagccagatgcattcaccttcgcctctgcaaagctgccttcgacattgtttgatgataggcggcaaataagttttgtctggaataaagctcctgttagccatgtaagacccttcacttctccatgggacagctcatctgacttaaagcccccttatgcaaaggaaataagtgatgtatcaacaaaagttgggacaattactggacaagttcatttggataaatctcacatgttcaatgctattccaacacttagccatggcaaagatgagccttggccaatgaaaggtctggacatgtctatatctgcttcaaaattcgatggagcagcggatcttcagcatgctctctctcttctgtcagccggcgcttgtggactgcctgattctgtacatcaaacatcttgcattatccaattcaatggtgccagcgagaacagcagtgaccttcatgtaacgcatggcaggaactctggtccagcatcatgcgccgatgcgcagcatatagctgcccagcctcagtctcagctgtttcattttaccacagataccggcaatactgtttatgagcccagtttctttggtgtaaaccagataaattaaccatggaagacccatgccccttgatcacttggatgaatagccctgaagatggtttgggcctgtgcaagtttttcaaccaacccccggacataaggatttttgttaatgttattttcatatttattggccatacctgaattcagttgaaccgagcttaggccagcttatgtttaatatgcagttccaacctgtgattgacccattttttatgttttttttgccctttgtgatgggagggggactactttgtaacattataagtgtgatactattgtagtttttactgccccgacgatgtaaacggttggatatttttgaagctgtccttgatgaatctggacatgtattttgtgtgtaaaaaaaaaaaaaaaaaaaaaaaaaaaaaaaaaaaaaaaaaaaaaaaaagggcggccgctctagagtatccctcgaggggcccgaagcttacgcgtacc

SEQ ID NO: 836 - DNA, 2636 bp, Zea mays
tctccacagtccacactgttcaccaactctcggcacgtctcttcgatccccaaatcccgaattgaccagcccaaatcgtcgccccggcgcatggagtggacggtcccgaagcccgcctcatcgcctcccctcctctgggaactggggagaccacgccgccacgggctcgggctcctccagcgacgccccggcgcggcgcggcgggaaggagcgggaggcgaagcgtgccagggccggcgaggaccgcgggggaggtgagctgaggtgccaggtcgaggggtgcggattggacctcagcagggtcaaggactaccaccgtaagcaccgcgtctgcgaggcccacactaagtctccccgcgtcatcgtcgccggccaggagcgccgcttctgccagcagtgcagccgattccatgcgctgtcagagtttgatcagaagaagaggagctgcaggaggcgtctgtctgatcacaatgcccgccgccggaagcctcagccagatgcattcaccttcgcctctgcaaagctgccttcgtcttactgtatgatgcatatatatctcctgtggcaatgaaccatgagtaggacctatattgtttttgctttgcttgggttcttgtaacccagatttcatgccctgtcagagtttgatcagaagaagaggagctgcaggaggcgtctgtctgatcacaatgcccgccgggagatgcattcgcctttgcctctgcaaggctgccttcgtcgtcgttcgatgataggaggcaaataagttttgtctggaataaagctcctgttagccatcctttcacttctccatgggacagctcatctgagctccctcatgcaaaggaaataagagaggtgtcaacgaaagttgggacaattactggacaagttcatttggataaatcttacgtgtccaatgctgttccatcacttacccatggcaaagatgagccttggccaatgaaaggtccgattcccccgtctcttcttctgcacagtccacactgttcacttcctgccccctccccgcacctccctccgatcccccaaatcccgaattgaccaacccaaagccgtcgccccgcatggagtggacggtcccgaagcgcgccgcctcgccgccctcgcctccgctcctctgggactgggggggagaccacgccggcgccacgggctcgggctcgggctcctccggcgacgccccggcgcggcgcggcgggagggagcgggaggcgaagcgcgccagggccgacgacggcgaggtgaggtgccaggtggaggggtgcgggctggacctcagcagggtcaaggagtaccaccggaagcaccgcgtctgcgaggcccacaccaagtccccccgcgtcgtcgtcgccggtcaggagcgacgcttctgccagcagtgcagccgatttcatgccctgtcagagtttgatcagaagaagaggagctgcaggaggcgtctgtctgatcacaatgcccgccgccggaagcctcagccagatgcattcgcctttgcctctgcaaggctgccttcatcgtcgttcgcagactttccaggacgaaaacgaaggggcctcctcccgaaagataaaagcatttctttgtttccagatttctcaagctgctatttgcacaacaagtttagtaatatgataggaggcaaataagttttgtctggaataaagctcctgttagccatgtaaggcctttcacttctccatgggacagctcatctgagctccctcatgcaaaggaaataaaagaggtgtcaacgaaagttgggacaattactggacaagttcatttggataaatcttacatgtccaatgctattccatcacttacccatggcaaagatgagccttggccaatgaaaggtccggacatgtctatagctgcttcaaaattcgatggagcaccggatcttcagcgtgctctctctcttctgtcagttggcgcctgcggattgcccgatcctgtacaccaaacatcttgcgttatccaattcactagtgccagcgagaacagtggcgaccttcatctatcacatggagcgaactctggtctagcgtcatgcggtgatggacagcatatagcttctcagcctcaggctcagctggttcgttttaccatggataccagcaatagtgtctatgagcccagtttcttcagtgtaaaccagataaattaagcgttgaagacacacgccacttggtcatttggataaatagccctgaagatggcctgagcctgtgcaagaagttcttcaaccaaccaccggacataaggatctatctgttaatgttatctgtgtatttattagccatacctgaattaagttgaacccaatctaggccagcttatgtgcaatatgcagttccaacctgtgattgacccattttttctgttgtttctttgcccgtgatgtgactgctctggaacttaagtgtgatactgttgtagttacactttactgccctgacaatgatgtcaaacggctggatatctttgaaactgtccttgatgaatctggacgtgtattttgtgtgtgtgtatatggtttttgcttcttcaatgcttgtccaaggaatatagatatataaaaagctgttgcatcaaaaaaaaaaaaaaaa

SEQ ID NO: 837 - DNA, 1249 bp, Zea mays
  misc_feature (137)..(137): n is a, c, g, or t
  misc_feature (198)..(198): n is a, c, g, or t
ttcgaccagaagaagaagagctgccgcaggcgactcacgaccacaacgcgcgcaggcggaaccccacccgaacgctccctttggtcacgagctgcgggatttctatggtatatgaaagggggggggggtgttcgtantttgtgaagggccctacggtcagatgagaagctgtgcgagttcttcgccgcgatagcccangagcaggaggaggaggcttcaaattcgcggagacgagaggagctccttggttgaagccggcaagagctgctgctgatgggctgctgcctttgtcaggtcagcagcagcagcagcaggtgtggaatgactcgattccgcatgttgcccatcaggaggatttcgatgggttcacggtcacggcgttcaaaggaatcagtccaaagacccttgatcatcaaggcgcaggcgttgaagcctgtgcggccgtctccagcccggacggcgccccggaccttcagcgtgctctctctcttctgtcaaacagtccggccggtggcggcgggcaccaacaccaaccacccgccgccgccgccggcggctgagctgcaccaccaccgcgctgccccgagcagctgcctcgccgccggctccgtctccgtgctgcaggaggcctcgtcgccggggctgtggcaggacggcggcggcagcgcggccctgggccaccacgcgcacgcgcggctccaggctctcgacgccgccatggcgacggcgcaggagctcctccagctccccaggccgccgccatcgtacggcggctcctcgtcccactacgacctgatgcgctgatgcttccttccttgtggattgtggtggagaactggagatggagcgggagcgccgccgtgcccccggttggcgcgtggaaatcagtcagacgtggcttctgtggcgtcgtctctgcaacgcgggagcgggattttgcttgtgttctgaacgaacagaaaataataaaaaagaagaaggccttgtcgccatgggaactcgtggaggtcgccggtagagctgcgcgcgcttgaataatccacggttttgtgacgctagcagttgaagttctattgatttgtgcaatgtaataacttggttgcttcggaagagttctattgtcatctttaatggcaccccccccccaattagctcaaaaaaaaaaaaaaaaaaaaaaaaaagggcggccgctctagagtatccctcgaggggcccgaagcttacgcgtacccagctttctgtacaaagt

SEQ ID NO: 838 - DNA, 1164 bp, Zea mays
atggggctgaggatagggaaggcatgcatgatagggacttcaaagacccagaaggaccccatggtgtgggattgggaacatctagtaccgtctgtctcaaatgcagttacaaggcacggatctgctaattcatctggtggtactcttacttctaactcagagctagggcatggttcatccaagagctctatttcagcgtccattgattcaccctctggagtagggaacagcttagagttcaacttcgccgctgttgagaggcatgttaagaacacgggcacgaacggcagagtcgatgactcggggaattctccatcgtcaatgatagctttcaaccaaggagagccattaatcagcctgaaacttgggaagagggcttacttcgaaaacgcctgcggaggacaggatgccaaggtttctgcagcttcagacgttacttctgcagccagcgtggtcaagaagactaaggtgtctcagcagaatgcaaagaactggtactgtcaggttgaagggtgcaaagttgacctgtcttctgctaaagattacaatcgcaagcacaagagcgtcggttttgtcaacagtgtagccgatacaaggcagcggacaaatcttttctttagtcaaccactttatggccaagtgaggagcaatgcagggtcttcatgggataacttgggaggcttaaaattcatggagacgaaacatccgccagtgcatccaacaaaaacagcatcccctgatgaactgcatttctcagccctccagataactagtgctgcggctcacaccggacatcatcatgatctcgatgggttcatggcgttcaagggaaccagcacaaaggtccttaaccaaggcgtggaggcttgggcggccgcttccagctcgaacaacggaggcccagaaggtgggcgtgctctctctcttctgtcagacggctcgtggggctcgagttcagccgtcatccagcagcccacatctcacgcggacgccggtgcattgctgccgcccctcgccaccgttgccgtctccaacgccgccgccgccgccgggcatcctctggacccgtccccgggaaggttctggccgcaagacgatcatcccccgctcgtcgacggacccgccacgcagattccggagctggcgcacctccggatatggtga

SEQ ID NO: 839 - DNA, 901 bp, Zea mays
aaaaaccccaagcccatacatccacactgcttagtctatagactctataccatagtttcaccaccatctagctttaccagaaatggagggtcagagatcacaacgctggggttacttgaaagacaaggctatagccaccagccttgctgaagaagaaatggaaaatagcatggatggagaggaggatgatactggagatgaagacaaaaggaagagagtgatggagagagctagaggtcctaacacagaacgtgttcccttgcggctgtgcctggtcgataggtgcactgctaacttaactgaggccaagcagtattaccgcagacacaaagtctgtgaggttcatgcaaaggcatcttctgcaactgttgctggagtcaagcaacgtttttgtcaacaatgcagcaggttccatgagctagcagagtttgatgaaactaaaagaagttgcaggaggcgcttagctggacacaatgagaggaggcggaagatatctggtgacagttacggagaagggtcaggccggagagcggttagcttgacacagactcaagaaagaaacaggatagacatgaaacttcctatgactaactcaccattcaagcgaccacagatcagataaaacaacatcaacacacccaaccgctctctctcttctgtcatctacttatgttatatatctacgttctctagctatccaaataatgacatctaagtaccatgtcaagaaaagtggatcgtggtattgaatcctacaacaatatataactacaaaactctagtaccctttatgttatcatttaaaggatgcatatccacaaatgtataagacttgtcatactcttgtattgtctaattatgtttagtagtctcgtatgtttcaagaaaaaaaaaaaaaaaa

SEQ ID NO: 840 - DNA, 1572 bp, Zea mays
cttccactcatgagaggcacggcaccagagctccagctccacatcgccagctcccgggccgcacctcgatcgcccaggccggcctcctccctcgccgccggcgccgccatggaccgcaagagcaagtccgccaagggcgccgcgagctcggcagcggcgtccatggccgcgctcggcggcgggccgaggtgccaggcggagcggtgcaacgcgaacctgatgaccgaggagaagccgtacaaccggaggcacaaggtgtgcgaggcgcaccgcaaggcgtccgtcgtcctcctcgccggcctccgccagcgcttctgccagcaatgcagccggtaagccccgcctgcctgcttgctcggaggcacatgcacatgggcgcagtgcagtgtgcagtccggccggcgtgcgtgactcgtacgtgagtgagttcgtgacatgctcaaaggcaccgcccgctttcagttcgtacggctactactactactaaactaaacgagcttaattcgaccttgaaaagtaaacttgcttgcctgaagcgcatcgggtcccttgagaaagcttgcagctttttttcttgggtcatggatagcacggtgagctgctggattggatcctaagctagctaggttgctctctcaactcaagatcttgcagaagcgtctctcagtctcatgcaacctctttggaggttattaatcaaaccgtgctagctcctctgcctggagcttctctccgcctgtgtcactctttcttgacccccggccctcgtctgctcgcaggttccacgagctgtcgcacttcgacgacaccaagcgcagctgccgcctgcgcctggcggggcacaacgagcggcgccggaggaacccggcggaggcgcaggaccagcacggcgggcggggcgacccggggagccaccacctccagatcagataaaaacctactacgtcagcatgctctctctcttctgtcatgcaggacgcacgcacctagcgtcgtcaccgatccatagtccgatatgtgtctcaagtgttgtgtgtgcgcgctctcgccgcctacccctgtcctgcagtgttgcgtagtatatggttctacgacctacacgtactgctgctactactgcgtgctaactttaatctgatggcagtccacagctagctagcacatcacctcctgtaagtaatgtgcttatctatatgtgcaccgaccggaaccggaggcgtgcgtacgctgatctgccacgaagcctactagtagttaaatgtaacgtaacctgcaggcaattaagcagggcgctgctatatatagcgtaattaattgtgcgtatgggtatggtggttcgattatcggatgtgtaatccctgtacgtggccgggcccgtgccaaacgtacggtgacctgtgcaggctctgtgtgtcgatgatgttgtactctgataatgatataatccattggggtaatgtatgctaaaaaaaaaaaaaccaaaaaaaaaaaaaaaaaaaaaaaaaaaagggcggccatcccgggaattccggaccggtaccagcctgcttttttgtacaaacttgttcttat

SEQ ID NO: 841 - DNA, 1297 bp, Zea mays
atggactgggacgccaagatgctccctgcctgggacctgggcacggtggtcgtgcccatcggcggcggcggcggcgcgctggacctgaagctgggcgcgccgacgagctcgagggcggcggtggccacggccgcgcccacgctgccgtcggcgaaccctccgccgccgccgccgccgccgtcgtcgtccgcgccgccgaagcggccgcgcccgggccacgcgcagcaggcggcgccggcgtgctccgtgcagggctgcgacgccgacctgtcccagtgccgcgactaccaccgccgccacaaggtctgcgtggcgcactccaaggcgcccttcgtcaccgtcgccggccagcagcagcgcttctgccagcagtgcagcaggtttcatctgctcgaggagttcgacgaggtgaagcgaagctgcaggaagcgcctcgacggacacaaccggcgccgccgcaagccgcagccggaccctctcagccctgccggcttgtttggcgatcaccaccatggaggagtgacaaggttcacatcgtacccacaccgcttcaccacatccatcgcaaagcccgaatggggggcggtcgtcaagacggagaccgacgcgttccaagaccagtactaccctgccgtccacctcaacggcgccggcgccggcgccctcttccacgacaaggaccggaagcacctcccattcctgaccaaccacaacaatggatgccagccattcaccgtcaccacgacggcttcctcagagagcagcagcaagcacagcaacggcaactgtgctctctctcttctgtcagacaacccgacaccagcacaggcacagacggccacgatccctaccgcgcagcccctcgtcgccacggcatcgcagtacggcaggctccctggcggcgacgacgacgacgtctccctcgccgggatgtcgtacatgagggtgggagacagccggcaggcttccaatctgacaacgtcctcacccggtcctgccactgcagctgcaacacagcagcacctgcagtaccaccatggctactactaccatgtgagcggtggcgagcagggcaacaacagcccagatggcgccgccattcaggccctccccttctcgtcgtggtagacgcgcgactttctgatgaagatcatgtgctaggataggcaggcagtcgctcttgttgttcaccaaacacatgggttgtaacactaggctcggtcatactgaaaaaccatgacaaaaaatgtccatttttcagcttgttctgataggtctaatctatggaaaattcttc

SEQ ID NO: 842 - DNA, 1810 bp, Zea mays
attcctcctcctccgaagcagcaggcagcagctgcatcgcacctcacacctctcgtgtccatcgatccagccgccgccgcagctgcagctctcacttcactgttgctgtgccacctcctcgtcgcctgtagtgtctgtcgatagataaacgcccgcggaatgagagggaaggagcggaagctgcagcgggcgcgcgcgtgcaagggctaggactagcggttgcaacgtcggcgcgcgcggcgtacgtcgggcatggattgggatctcaacgcggcgggcgcgtgggacctcgcggagctggagcaggaccacgcggccgcggcgccgtcgtcggggggccacgccgccaatgctgccgcggcgggcacggggacggagagccgcccgccggcgcccggggcagcaggggcacccgccgagtgctccgtggacctgaagctgggcgggatgggcgagtgcgagcccggcgcggcccgcagggagagggaggccgcggcgggggcggcgaagcggccgcgccccgccgggcccggcgggcagcagcagcagcagcagtgcccgtcgtgcgcggtggacgggtgcagggcggacctgggcaagtgccgcgactaccaccggcggcacaaggtgtgcgaggcgcactccaagacccccgtcgtcgtcgtcgccggccgcgagatgcgcttctgccagcagtgcagcaggttccatctacttgcagagttcgacgccgacaagcgcagctgcagaaagcgtctggacgggcacaatcgccgccgcaggaagccacagccagacaccatggcttctgctagctttatcgcaagccagcaaggcacgcgattctcaccatttgcgcatccaagactggaggcgagctggccgccgggggtgatgaaaaccgaggagagtccatatcacatcactcaccaaatccctctgggctccagcagcagcagcaggcagcagcatttcgtggctctgggagccgccacgcctgcctacgccaaggaaggccggcgcttccctttcctgcaggagggcgagataagcttcgccaccggcgtggtgctggagccgccggcggcggctccagcgtgccagccgctcctcaggacgggagcaccatccgagagcagcggcgccggcggcagtaagatgttctccgatcaggggctggctcgcgtgctcgactcggactgtgctctctctcttctgtcagcgccggccaactcctccggcatcgacgtcagcaggatggtccgcccgactgaacacgtccccatggcccagcagcccgtggtcccgggcctgcagttcggcagcgcgtcgtggttcccgcgcccccaggcttccacgggcggctccttcgtcccctcctgccccgccgcggtggagggcgagcagcagctgaacgccgtgctgggccccaacgacagcgaggtgagcatgaactacggcgggatgttccacgtcggcggcggcagcggcggcggcgagggctcctcggacggcggcacctcgtcgtcgatgcccttctcgtggcagtagtcgtcgtcacttgtcagcagccgctgcgttctctcatctttcgcgcttcagacgatctggtagggagatactggctttagtgatcactgatcagcattgatttctgttctttttcctgcattcgctttgttgaatcggctctgctcgccagcattcgtgtggacattttttgaacataattctgtgttcgtttccctcaaaaaaaaaaaaaaaaaaaaaaaaaaaaaaaaaaaaaaaaaaaaaaaaaaaaaaaaaaaaa

SEQ ID NO: 843 - DNA, 1434 bp, Zea mays
attcggctcgagcatggatcaggttgaccaagcggggatgctgaaacaatctggctgtgtgcttcctgcattgagcgatgccattgacagtgtgctttcctcagctgatcatttttcaaatgactctgagaagctcaggcaggctttaggttttgattatctgaatgaagccaatgctagcagcaagagtattgcacctttcggggttgcacttactggcagccatgcctttttaaatggcaatttctctgcttctaggcccacaaatggtcctttgaagatggagctcccttcactccaagatactgaatctgatccaaatagctggctcaagtatactgtggctcctgcaatgcagcctactgaattagtagatccttacctgcagtctccatcagcgaccccttcagtgaaatctgagtgtgcatcgccgaggaacagtggtcttttggaagagctgcttcatgaagctcaggcactaagatctgggaagaaccaacaatcatcggtccgaagttcaagttcttctgctggcacaccttatgagactaccacggtggttagcccagagtttgatatgggtcaggaatattgggaagaacagcccagttctttcctcagtgaatatgctcattttagtggaaattctttcactgaatccactcctcctgttagtgctgcgtcacctgatatcttccagctctccaagatttctcctgcacaaagcccttcaatgggctctggcgagcaggcgttagagcctaaacatgagtcggcagcttcacctcgtcctgaaaacttgaggcctgatgcattattctctgggaacacagccgatccatccattttcaataatgccatagccatgctcctgggcaatggcattgatgccgagtacaaacctgttcttggtgatggaattgtgctcgattcttcgtcatggaacaacatgcaacatgcttttcagatggcgggattcaaatgagttccatgcacttgtttgtgatgctgaagggcttcttgttgcttgttttggggtcagtatcagcgaaggccgcattgattgtgacgctgcattcctgacagagggcgtgcaggtgcagcagctaccatatgtgatcttcatgctaatagtccttttgtctaataaagtgcatgaagataaaccggatattttttttttgctttgtattagagaaccgtttttgtcaaccctgtcaggattctgttggaaatgtgtcatgatttttgtttgaacaatttaatatctgtcattggtactgtgctgtgtgctactccttgatgcatttgcttgtggcagcaaattgtttaagtatacactgtcattgctgcgggcaaaaaaaaaaaaaaaaaaaagggcggccgctctagagtatccctcgaggggcccaagcttacgcgtacccagctttc

SEQ ID NO: 844 - DNA, 1020 bp, Zea mays
atggctcgaccacctggcggcgcccgccggcggggcggaggcagcggcaggagggacgcggcgggcgggtgcgaggcggtgcggaaggggcactggacagcggaggaggacggtgtgctgctggagcacgtgcgcgtgcacggcccccgggactggagcttcattcgatccaaaggattgctgccgcgcaccggcaagtcctgccgcctccgctgggtgaacaagctcaggccagacctcaagaccggctgcaagttctctgcagaggaggagcgggtggtgctggagctgcaggcgcagttcgggaacaagtgggcgaggatcgctacctacttgccgggcaggacggacaacgacgtcaagaacttctggagcacccgccagaagcggctcgccaggctgctgggagcgcctatccgccgccgccagtccagcaggagcaggagcgccaaggcgcctgttgcctcctctctgaagtcgcgacccgccaccgtggttccctgcctggatcaagttccattggagggcagctccaccggtgtccacccatgcagcgcaggcgcagcaacaccattcatggacgcgcacagtatcagtgctgcactagccccgtatgattgggcaggctccgggcttgccagttccgacggagcactgccgctggcctccgacatacacgcctgctcgtcatcaaacgctgccgcactgccaccactgctgccgttcgaccagcctccgtgcactgagcttggcttcccagggctaccggctggctggaacatggctcctgggttcgacaacgtcggcactatggatcatctcgcctaccaggagctgctcccggtgacgcaacccgctccaatgatgctcccgttcttcggcacggagtacctgcacggtggcgccaaggccgagcttcctgacgcggggcccgactacttcttcgacgacctgccgccggacatgttcgactcccttgatcagccgcctcggccactgtcaccgcctgcgacgagctag

SEQ ID NO: 845 - DNA, 1041 bp, Zea mays
atggctcgagcacctggcggcgcccgccggcggggcggaggcagcggcaggaggggccaggcggacgggggccaggcggtgcgcaagggccactggacggcggaggaggacgcggtgctgctgaggcacgtgctcgtgcacggcccccgggactggagctccattcgatccaaaggcttcctgccgcgcacgggcaagtcctgccgcctccgctgggtgaacaagctcaggccagacctcaagactggctgcaagttctccgcagaggaggagcgggtggtgctggagctgcaggcgcagttcgggaacaaatgggcgaggatctccacctacttgccgggcaggacggacaacgacgtgaagaacttctggagcacccgccagaagcggatcgccaggctgctgggaacgcctccccgcggccggtccagcaggagccggagccgcagcgccaagggcaaggcgcctgttgttgcctcctctctcgagtcacgacccgccaccgtggttccctgcctggatgaagttccattggagggcagctcatccggtgttgtccacccatgcagcgcagcaacaccattcatggagacgcgcagcgtcagtgccgcactagccccgtatgattgggcaggctccgggcttttcagtttcgacgacggagcactgccgctggcctgcaacagccacgcgtgctcgtcatcgaacgctgccgcactgctgccgttcgaccagcctccgtaccctctgctcgacgtccaagtccaaggggtaccggcgggctggaactggaacatggctcctgggtttgccaacgccggcgctacggatcatctcgcctaccaggagctgctcccgttgacgcaagccgccccaatggtactcccgttcttcgacgcggagtacccgctcggcggcgtcaaggccgagcttccggacgccgcgcccgataacttcgacgacctgccgccagacgtgttcgactccttcgaccagccgcccccgccagtgtcaccgcctgcgactagctctgggttttga

SEQ ID NO: 846 - DNA, 1638 bp, Zea mays
atttcagttgcctggccgcacagataatgaaataaagaacttttggaataccagaaaaagaagaaaacagagatgtggttcgcctctctatccagaatatatgctttctcaggttagtcataaagacatggactttgaaactcttggagagtcacatggcaagaaacggtcaaatgatttttcaaaagaaaaggttggtgatgtgcaagaacttgtggatgagttaattgtatttgagcaccttgactatggtaaggatatagtgtttccaatcagacctttgaaatgccatgcatctactggcagtgtgcaaatttctggtgacattcggaaaaccttttgtcccactgatttgaactatgtaatgacaaagaatcagtcggtgcctgttggtagtgccattggcagtggctatccagtatatggtggcagactctctacttcagggaccatattcggttccattcagacagagattccttcgatccaaagttccagctatagcccaagtaatgactggttggctcaatgtccttcggcttgcattgagcaacggattccaatggaatgcaatacaatatctcagtcaaaagcttaccttatgatgcattcttcttcagctttctgtgcccctgaacatgatgcctgttctgaaactcaagctccagacttatgttcaggttcagatgttgttttcgaccccagccaatgttatccagttgctagtttttctgatcttgggatctcggataccccactaacatcagtttcttgaatgatatagcactagcaagtttgttgaatgttaatttgaaggaccagtcacatatcaacaggcaggaacctaccaatgatacatcactaggaggagcaagtttcttgaatgctaatttgaaggaccagtcacatctcaactggcaggaacatatgaatgagacatcaccagtagcaggtttattgaatgctaatttggaggagcagtcacatctcaactggcaggaacctaagaatgagtcatcaccagaagcaggtttcttgaatgctaatttggaggagcagtcacatctcaactggcccttgcaggaatgtgagccatggattgagagacaaatgttttgaccaatagtttgatccttgttacaagcctgacttcccatgttcctgagcagcagtttcctctactgcacaaccagggccagagtgagcaacaaccaagatattcttgtgagcgtgatggaaattacattttagttctctgccttcgctgtcttaagctctctgaagtattgtcttcgactttgctgggatgatgagctgctgccccgagacaacaacagtcagccagaccaaaatcacttaaatagttttaacaatgtattaagttttgtcttgttacctgctgtctggcgtctgccatgttttgtccactgttaaacttgtctaataatacccttttagggctaatttggaaagcctcaatgtcttaagttttgtcttggtaaaaaaaaaaaaaaaaaaaaaaaaaagggcggccgctctagagtatccctcgaggggcccaagcttacgcgtaccctagctttcgagttgtgcactgcaaaataattgtatctcgtgccgagtcatatagcttgggcc

SEQ ID NO: 847 - DNA, 1048 bp, Zea mays
acgacgacccagcagacggcgcagttcctctcgccgccgcccttctcggcgccgtcgtccccgtgggccaagccgttcgcgcggaacgcgcagtacttccagctcgcgcactcgtcgcccgtgtccccgtcgacgccgaccgggccggtgcacccggccatgccggacctgtctctcggcggccacggcgcgcgcgccgccgccgctgccgaccagagcaggctcccaccgctctcgccgtcccccggccccagagtggagctcccttcaaaccaatacggccagccggcgccgccgacctcggccgccgccgtcgccgccggacttgcgctgccggatcatcagaacgcggcgagcctcgaacagatgctgcaggagctgcacgacgtcatcaaggtcgaaccgcaggcgctggtcccggccagcggcggcggcgctgcactggagcggcatgattgcggagtttcagtcccagagagcagaatcagcggcctgcagcgtcgggctgacgacatggacacgctgttcggcctggtgcgcccggcgctcggcgcgccggagacggcgccggcggccgccgcctccaaccactccggctcgacctcgcggcacagcaccgccgaccagaacccgtccaccgtcggcaacagctcgccggaccaggactggggcctcgacggcgtctgccagtggagcaacgtgtccaggatctgctgatcgcgtgcaagagctgcagggggggtcggcgtagccatgccgaatcatcgattaggacacccatccgatccgatgattctgagaagggccggagacggattgccgaccttttcttttttgcttttgaacatttcagcctgacagatgccaagcatcacggacaaatctgtctgtgttctgttctccgttcctgacgaactagttgccggctcaatctcgaactcagctgcgatcgaatctgcgtcagcgtctctagctagcatgttgttttccagtttccagttcaattgacatcatcaatcaattgtagaatttaaaaaaaaaaaaaaaa

SEQ ID NO: 848 - DNA, 1121 bp, Zea mays
attcccggccgacccagcgtccgcgccgttggtcgctcatggagaagagcccgggcgccgcgccgacatcatcgcccgaggaggaggtggcggcggatggccacgggcatgttgaggacgcgacggggcagaaggagcaggcgacgccggttgtgctcaagaaggggccgtggacggcagcggaggatgccatgctcatggacctgtccctcggctacggcgtacgcagcgccggcgtcggcgccggcgccgaccagagcaggctcccgccgctctcgccgtccccttgccccagagtggtggagctcccttcaaaccaatacgcccaaccgacgccgccggcctcggccgccgccaccgcacttggaggtggtggcgcagcgctgccggatcatcagaacgcggcgagcctcgagaagatgctgcgcgagctgcatgacgtcatcaaggtcgacccgccggcgctggtcccggccagcggcggcgctgccctggagtggcatggtggcggagaatttgtgagcggcctgcaggccctgcagcagcatcgggttgacgacatggatactctgttcggcctgctgcacccgccgctccgccgcgcgccggagacggtggcggcggcagctgcaggctccacccactccggctcgacctcgcagcacagcagcgacgaccagaagcccaccgacgtcgtcggcctcggcctggacctggacctccaggtcgccggcagcaccgtctcgtcggaccaggaggactggggcctcgacgccgtctgtcagtggagcagcgtgtccaggatttgctgatcgcgtgcacggactgcagggatcggcgtagcgatgccgaatcgtcggtcaagacatcgtgcatgcatccggtgattctgagaactggaagagagagagaatgcctttttttttgaacgtttaaatttcttgctgctgtcagatgccaagcagcatgggcaaacggatttgtttcccgttcaatgttcatgacgactatggttggttagttaccgagtcggctgcgcaacccaaaaaaaaaaaaaaaaaaaagggcggccgctctagagtatccctcgaggggcccaagcttacgcgtacccagctttc

SEQ ID NO: 849 - DNA, 2324 bp, Zea mays
atctctttctctttctctctctctcctgaaatctctctctcgctgacctgagagttatccaaatactctggtatggcgagatccccctcctcgggttcccactcaactgctgtatcgtagtagtcgactacttccctgcaatccgttggtcagctcacaatagcagatgagtccattggaggagttcgactagtctccaccgctgctgcgagattccgccagtgaagattataaaacttctgcccgagcaaagcggccgaccaagttaccacagagcaagtcagcgaggcgaaataggcgaccaagtcccaacaaccgagtaagaaagggagacgaaactgccgaccaagtctctaggcccacaaggttccgcgcataccctgacggcgtgccatgtaccgggtgaagagccagggcgagggcgagatgatgtcgcaggaccagatgcactcgccggtggacaacgatgtcagcagcagccgcaggtcgcctcgcaggggcgtcggggcgcccctgaagaaagggccctggacggacgcggaggacgccatcctgatagactacgttaagaagcacggcgtgggcaactggaacgcggtgcggaagaacaccgagctattgcgctgcggcaagagctgccgcctcaggtgggcgaaccacctcaggcccaacctcaagaaggaggccttcaccccggaggaggagcgcctcatcatccagctccacgccaagctggggaacaagtggtcgaggatggctattcatttgccagggcgtactgacaacgaaataaaaaactactggaacacacgaaaaaagagatgtgaacgagctagccttcctatctatcctgctggtgtacgtaatcaatcttcaaatgaagaccagcaattgtctggcgatttgaacggtggcgagaacatgtccaatgatcttctatccggaaacagcctttgtctaccagattttaacaatgacagtttccttgcgaaactgcaggctttaccaccacagctgccagctgtttcaataagcaatttgctcggccaaagctttgcatcaaaaggttgtagcttcatggatcaggtagaccaagcagggatgctgaaacaatctggcagtgcgcttcctacattgagcgatgccattgacgatgtgatttcctcggttgatcaattttcaaatgactctgagaagctcatgcagactttaggttttggttatctcaatgaagccaacgctaccagcaagagtattgtgcctttcggggttgcacttactggcagccatgcccctttaaatggtattttctctgcttctaggctcacaaatggtccttcgaagatggagcccccttcagtccaaaatagcaggctcaagtatactgtggatcctgcaatgcagcctactgagttagtagatccttacatgcagtctctatcagcgaccccttcagtgaaatcagagtgtgcatcgccgagaaacagtggtcttttcgaagagctgcttcatgaacctcatgcactaagatctgggaagagccaacaaccatcggtccgaagttcaagttcttctgctggcacaccttatgggactatggttagctcagaatttgatatgggtcaggaatattgggaagaacagcccggttctctcctcagcgaatatgctcacttcagcgggaattatttggctgaatgcgctcctcctgttagcgctgcatcaactgatatctttccgctccccaagatttctcctgcagaaagcccttcaatgggctctggcgagcaggcgttagagcctaaacatgagtcagcagcttcacgtcatcttggaaacttgaggcatgatgcattattctctgggaacacagcccattcatccagtttcaacgataccataacaatgctcatcggcgatgtacctgttcttggtgatggaattgtgctcgattcttcctcatgggacaacatgccacatgcttttcaaatggcggaattcaaatgagttccatataatttctttgtgatgctgaagggcttcttcctgcttgttttggggtcaatatcagggaacgccccactgattgtgacgctgcattcctgacagagatccttgtgatcttcatgcggatagtccttttgtctaattaagtgcatggaagataacctggatattatttttaattttttgctttgtattagagaaccgtttttgtcatccctgacagcatttctgttggaaacgtgtcatgacttttgtttgaacaatttaaatgtcggttatagataatgtgatgtgtgccatcaaaaaaaaaaaaaaaa

SEQ ID NO: 850 - DNA, 1572 bp, Zea mays
gtgacactatagaacaagtttgtacaaaaaagcaggctggtaccggtccggaattcccgggatggcagacagccaaatgccccaccacagcgtagcccctcctcactgactcgcctgcaaaaaccacttgcaaaccacacaaaccgaaaacgccagctcccctgcctccatttttagcaacttttcccttctgtcttcccatcacagtcacccttcttgcccccacgcagccgagcgtgcctacccctcctcgacccttctctggggccgccgttggacgctcatggagaggagtcgtccgggcgccgcgccgacaccatcgccagaggaggaggtggcggcggagggccatgcgcatggtgacgatgtgacggggcaggaggaggaggcgacgccagtggtgctcaagaagggcccgtggacggcctcggaggatgccatgctcatggaccacgtccggcaccacggcgaggggaactggaacgcagtgcagaggatgaccggcctgctgcgctgcggcaagagctgccgcctgcgctggaccaaccacctccgccccaacctcaagaagggctccttctcccccgacgaggagctcctcatagcccagctccacgcgcagctcggcaacaagtgggcgcgcatggccgcgcacctgcccgggaggacggacaacgagatcaagaactactggaacacgaggaccaagcgccgccagcgcgccggcctgcccgtgtacccgccggaggtgcagctccaccttgccctctccaagcgctgccactacgacgactacgacttcccgccgctcgcgtcgtccccgcagctgtcggcgacgacgacgaccgatgtccaggcgctgggcgccgggcccgggtacgccagctcgcgcccggcgccgctcgacctggctcgcagccagctcgccgcgacgacgacccagcagacggcgcagttcctctcgccgccgcccttctcggcgccgtcgtccccgtgggccaagccgttcgcgcggaacgcgcagtacttccagctcgcgcactcgtcgcccgtgtccccgtcgacgccgaccgggccggtgcacccggccatgccggacctgtctctcggcggccacggcgcgcgcgccgccgccgctgccgaccagagcaggctcccaccgctctcgccgtcccccggccccagagtggagctcccttcaaaccaatacggccagccggcgccgccgacctcggccgccgccgtcgccgccggacttgcgctgccggatcatcagaacgcggcgagcctcgaacagatgctgcaggagctgcacgacgtcatcaaggtcgaaccgcaggcgctggtcccggccagcggcggcggcgctgcactggagcggcatgattgcggagtttcagtcccagagagcagaatcagcggcctgcagcgtcggggtgacgacatggacacgctgttcggcctggtgcacccagcgctcggcgcgccggagacggcgccggcggccgctctagagtatccctcgaggggcccaagcttacgcgtacccagctttctggacaaagtggtccc

SEQ ID NO: 851 - DNA, 2400 bp, Zea mays
gacactatagaacaagtttgtacaaaaaagcaggctggtaccggtccggaattcccgggattctctctctctatctctctctcagtctctctcttccgcacgagaccattacctagaacatcctaatcgaaaacacatactctgctgctgctaagtggtggcatctcgtttaggcgagatccccctcctcccccgctttccactcctctcctccaccctagtcgactccttccctgcaatccgctggccggctcacagtaccagaggagtccaccggaggagctcagctagactcccaccctggtggctcgatcggcaccggccgctgcctgcgagactccgccagcgcgcgatgtaccgggtgaagagcgagggggagggcgagggcgagggcgactgcgaaatgatgctgcaggaacagatggactcgctggtggccgacgacgtcagcagcggaggagggtcgcctcacaggggcgtcggcacgcccctgaagaaggggccatggacgtccgcggaggacgccatcctggtggactacgttaagaagaacggcgagggcaactggaacgcggtgcagaagaacaccgggctgttccgctgcggcaagagctgccgcctccggtgggcgaaccacctcaggcccaacctcaagaagggggccttcacccccgaggaggagcgcctcatcatccagctccacgccaagatggggaacaagtgggcgaggatggctggtcacttgccagggcgtactgacaatgagatcaagaactactggaacactcgaataaagagatgtcaacgagctagccttcctatttatcctgctagtgtatgcaatcaatctacaaatgaagatcagcaactgtctggtaattttaacggtggcgagaatatatccaatgatcttctatctgggaacagcctttatctgccagattttaccagtgacaatttcattgcgaacccagaggctttatcctatgcaccacagttgtcagctgtttcaataagcaatttgctcggccaaagctttgcatcaaaaagttgtagcttcatggatcaggttgaccaagcggggatgctgaaacaatctggctgtgtgcttcctgcattgagcgatgccattgacagtgtgctttcctcagctgatcatttttcaaatgactctgagaagctcaggcaggctttaggttttgattatctgaatgaagccaatgctagcagcaagagtattgcacctttcggggttgcacttactggcagccatgcctttttaaatggcaatttctctgcttctaggcccacaaatggtcctttgaagatggagctcccttcactccaagatactgaatctgatccaaatagctggctcaagtatactgtggctcctgcaatgcagcctactgaattagtagatccttacctgcagtctccatcagcgaccccttcagtgaaatctgagtgtgcatcgccgaggaacagtggtcttttggaagagctgcttcatgaagctcaggcactaagatctgggaagaaccaacaatcatcggtccgaagttcaagttcttctgctggcacaccttatgagactaccacggtggttagcccagagtttgatatgggtcaggaatattgggaagaacagcccagttctttcctcagtgaatatgctcattttagtggaaattctttcactgaatccactcctcctgttagtgctgcgtcacctgatatcttccagctctccaagatttctcctgcacaaagcccttcaatgggctctggcgagcaggcgttagagcctaaacatgagtcggcagcttcacctcgtcctgaaaacttgaggcctgatgcattattctctgggaacacagccgatccatccattttcaataatgccatagccatgctcctgggcaatggcattgatgccgagtacaaacctgttcttggtgatggaattgtgctcgattcttcgtcatggaacaacatgcaacatgcttttcagatggcgggattcaaatgagttccatgcacttgtttgtgatgctgaagggcttcttgttgcttgttttggggtcagtatcagcgaaggccgcattgattgtgacgctgcattcctgacagagggcgtgcaggtgcagcagctaccatatgtgatcttcatgctaatagtccttttgtctaataaagtgcatgaagataaaccggatattttttttttgctttgtattagagaaccgtttttgtcaaccctgtcaggattctgttggaaatgtgtcatgatttttgtttgaacaatttaatatctgtcattgatacaaaaaaaaaaaaaaaaaaaaaacgggccgccgcgcggggctatccctcgaggggcccaagcttacgcgtacc

SEQ ID NO: 852 - DNA, 1926 bp, Zea mays
ccgcctcttttcccccgggcggttggccgggttcccttaaatccaaatgggcttggcccaggtttttcccgactccgaaaaaaccggcccctcggggccccacccccatttaaaagggggtttagtcccccccctttaggcaccccccgggtttttcccttttatgctttccgggcccctacttttggttggaaatattgaaggggaaaacaattctcccccacggaaacagttttgcccctgattccccccaagcttggaaatttaccccccctaaaggggaacaaaaagctggagcttccccccgcggtgggcggcgcctttagaactagtgggatccccccgggctgcaggaatcggcccgagagctcactagtcccccccccccccccggagcaacaatggattttttcgacgaagacaggcctagattcgttttccaatctcgtccttcttcttctcacacggcggaggaagaagaagaagctagaatccctaacaagcttttcatttcaatctccgtctcaatctccctcatcatattatctctctccttcttctacttcgaatctgaacctgccaaatcgctactattatggctttccctctctttcctcgtcggtcctttcgctcctagctcgctcaccggaggtaagattcgcgtcggttatggtcagatcttggagccagaacagattcacgatgagtcatccacggataacgaacgtgaatccaggaggaaatcggtgaataagcgatctaaaggctcgacgaagagcgataatccgccggaaaatgcttctgcggtgactgaagtttcgaggaaagtggtgattccgcagtctaaggagagtggatctgtgaatgaaactaaagattggactgctgaagagatcgagattttgaagaagcagttgattaagcatccagctggtaaacctgggagatgggagacggtggcttcagcgttcggaggaagatccaagccagagaatgtgattaagaaggcgaaagagataggtgagaagaaaatctatgagagtgatgattacgctcagtttttaaagaataggaaagcttcagatcctagattggttgatgaaaacgaagagaattctggagctggtggagatgcggaaggtactaaggagatttggagtaatggagaagacattgcattgctcaatgctttaaaagcttttcctaaggaggcagctatgagatgggagaagattgcagctgcagtacctgggaagtcgaaagcagcttgtatgaagagagttactgagcttaaaaaagggtttcggagctcgaaaactccagctaattaactagaggacatctgtacgggattaaggcaaataccaggagaggaaaaacaattttgtgtttgctgcttgagattattgctacaacgcccaaagtagtgaatagagttctgcaggaagtttcttttagagagaagaaaagaaagcatctcaatatgccaaagaatttaacataaagttatgagttcttctttacttcaagctttgattcgaattacaagacttgagcatctgtgtatcccctccccaaagagcacctattttattactagggaaatatataaaaagactatatatattcttaatccaaaaaaaaaaaaaaaaaaactcgagggggggcccggtacccaattgttaaacacaataaagttggaactggaggggggaaagctttttacaccggcgtggaaaagaatggtttccccattacccaatttaaaccgccttggagaaaatcccccttttccccggtaggggaaaaaggaaaagggccccacccaaatgcccttttcccaaaattgggcccccccgaaagggggaaagggcaatttggaagcgggaaaatttttgggaaaaaaccccgggaaattttttgtgt

SEQ ID NO: 853 - DNA, 1380 bp, Zea mays
atggagaagagcccgggcgccgcgccgacatcatcgcccgaggaggaggtggcggcggatggccgcgggcacgttgaggacgcgacggggcagaaggagcaggcgacgccggtggtgctcaagaaggggccgtggacggcagcggaggatgccatgctcatggaccacgtccggcaccacggcgaggggaactggaacgcagtgcagagggtgaccggcctgctgcgctgcggcaagagctgccgcctgcgctggaccaaccacctccgccccaacctcaagaagggctccttctcccccgacgaggagctcctcatcgcccagctccacgcgcagctcggcaacaagtgggcgcgcatggccgcgcatctgccggggaggacggacaacgagatcaagaactactggaacacgaggaccaagcgccgccagcgcgccggcctgcctgtgcacccgccgccagaggtgcagctccagctcgccctcgccaggcgctgccgctacgacgacttctcgccgctgccgtccccgcaggagctgtccggtgtccaggcgctggtgggcgccgccgcctcggccgggtacgccagctcccgcccggcgcccctcgacctggctcggcagctcacccagacgacgaaccagcagacggagactgtgcagttcctctcgccgccacccttctcggcgccgtcgtccccgtgggcgaggccgttcgcccggaacgcgcagtacttccagctcgcgcactcgtcgtcgcccgtgtccccgacgacgccggacctgtccctcggctacggcgcgcgcagcgccggcgccgaccagagcaggctcccgccgctctcgccgtccccttgccccagagtggtggagctcccttcaaaccaatacgcccaaccgacgccaccggcctcggccgccgccaccgcacatggaggtggtggcgcagcgctgccggatcatcagaacgcggcgagcctcgagaagatgctgcgcgagctgcatgacgtcatcaaggtcgacccgccggcgctggtcccggccagcggcggcgctgccctggagtggcatggtggcggagaatttgtgagcggcctgcaggccctgcagcagcatcgggttgacgacatggatactctgttcggcctgctgcacccgccgctccgccgcgcgccggagacggtggcggcggcagctgcaggctccacccactccggctcgacctcgcagcacagcagcgacgaccagaagcccaccgacgtcgtcggcctcggcctggacctggacctccaggtcgccggcagcaccgtctcgtcggaccaggaggactggggcctcgacgccgtctgtcagtggagcagcgtgtccaggatctgctga

SEQ ID NO: 854 - DNA, 1428 bp, Zea mays
atggagaggagtcgtccgggcgccgcgccgacaccatcgccagaggaggaggtggcggcggagggccatgcgcatggtgacgatgtgacggggcaggaggaggaggcgacgccagtggtgctcaagaagggcccgtggacggcctcggaggatgccatgctcatggaccacgtccggcaccacggcgaggggaactggaacgcagtgcagaggatgaccggcctgctgcgctgcggcaagagctgccgcctgcgctggaccaaccacctccgccccaacctcaagaagggctccttctccccccgacgaggagctcctcatagcccagctccacgcgcagctcggcaacaagtgggcgcgcatggccgcgcacttcgttcgttcctgtgccggttgctggttggttgcattggttggcttggtgcgcgcccgcagctgcccgggaggacggacaacgagatcaagaactactggaacacgaggaccaagcgccgccagcgcgccggcctgcccgtgtacccgccggaggtgcagctccaccttgccctctccaagcgctgccactacgacgactacgacttcccgccgctcgcgtcgtccccgcagctgtcggcgacgacgacgaccgatgtccaggcgctgggcgccgggcccgggtacgccagctcgcgcccggcgccgctcgacctggctcgcagccagctcgccgcgacgacgacccagcagacggcgcagttcctctcgccgccgcccttctcggcgccgtcgtccccgtgggccaagccgttcgcgcggaacgcgcagtacttccagctcgcgcactcgtcgcccgtgtccccgtcgacgccgaccgggccggtgcacccggccatgccggacctgtctctcggcggccacggcgcgcgcgccgccgccgctgccgaccagagcaggctcccaccgctctcgccgtcccccggccccagagtggagctcccttcaaaccaatacggccagccggcgccgccgacctcggccgccgccgtcgccgccggacttgcgctgccggatcatcagaacgcggcgagcctcgaacagatgctgcaggagctgcacgacgtcatcaaggtcgaaccgcaggcgctggtcccggccagcggcggcggcgctgcactggagcggcatgattgcggagtttcagtcccagagagcagaatcagcggcctgcagcgtcggggtgacgacatggacacgctgttcggcctggtgcacccagcgctcggcgcgccggagacggcgccggcggccgccgcctccaaccactccggctcgacctcgcggcacagcaccgccgaccagaacccgtccaccgtcggcaacagctcgccggaccaggactggggcctcgacggcgtctgccagtggagcaacgtgtccaggatctgctga

SEQ ID NO: 855 - DNA, 1264 bp, Zea mays
atgacggtggtgagggtggacgagaaccctgcgccggatggagagaactctcccctagacgatgagtacgtctcggccgacgatgaacacgttgatgatgaagacaaggagaccgatagcatcgacgactatgaaaaccccagcgggacgccccagatgaagaagggtccctggtcgcccgaagaggataagcgtctcaaagactacgtcgaggtacacggcgcggggaactggaataaggtgcagcagaatgccaggctcaaccgctgtggcaagagctgtcgtctccgctggacgaaccacctcaggcccgatcttaagaaggagcctttcaacgctgaggaagaggaaaagataatcaagcttcacattagacggggccccaagtggtccatgatggcctcatatcttactcataaagacatggactgtgaaactcctggagaatcacatggcaagaaacggtcaaatgagtgctcaaaagaaaaggttgctgatgtgcaagaacttgtggatgagttaattgtatttgagcaccttgactatggtaaggatacaatgtttccaaccagacctttgaaacaccatgcatctactagcagtgtgcaaattcctggtgacattgagaaaaccttttgtcccaaaaacttgaactatgtaatgacaaagaaccagtcgatgcctgttggtagtgccattggcagtggctatccagtatatggtggcagactatctacttcagggaccatattcagttccattcagacggagatcccttcgatccaaagttccagctatagcccaagtaatgactggtttgctcaatgtccttcggcttgcattgagcaatggattccaatggaatgcaatacaatatctcaatcaaatgcttaccttatgatgcattcttcttcagctttctgtgcccctgaacatgagggttgttctgaaactcaagctccaaacttatgttcagatgttgttttcgatcccagccagtgttatccagttgctagtttttctgatcttgggatcccggatacaccactaacagcaggtttcttgaatgatatagcactagaccagtcacatctcaaccggcaggaacctaggaatgagacatcaccagaagcaggtttcttgaatgctaatttggaggagcagtcacatctcaactggcacttgcaggaacctgagccgtggactgatggagacaaatgttttgaccaatggtttgatccttgtcacatgcctgacttcccag

SEQ ID NO: 856 - DNA, 1495 bp, Zea mays
aggtgaactatagaacaagtttgtacaaaaaagcaggctggtaccggtccggaattcccgggatcgcagccgagcgtgcctacccctcctcgacccttctctggggccgccgttggacgctcatggagaggagtcgtcggggcgccgcgccgacaccatcgccagaggaggaggtggcggcggaggggcatgcgcatggtgacgatgtgacggggcaggaggaggaggcgacgccagtggtgctcaagaagggcccgtggacggcctcgcaggatgccatgctcatggaccacgtccggcaccacggcgaggggaactggaacgcagtgcagaggatgaccggcctgctgcgctgcggcaagagctgccgcctgcgctggaccaaccacctccgccccaacctcaagaagggctccttctcccccgacgaggagctcctcatcgcccagctccacgcgcagctcggcaacaagtgggcgcgcatggccgcgcacgtaagcaccctatcctttgccctggataacaaatttatttatggcgagtggcggcgacctgctgatgtgactgacgtttgcgagttcgttcgatcctgtgccggttgctggatggttgcattgggtggcttgatgcgcgcgcgctgctgcccgggaggacggacaacgagatcaagaactactggaacacgaggaccgagcgccgccagcgcgccggcctgcccgtgtacccgccggaggtgcagctccaccttgccctctccaagcgctgccactacgacgactacgacttcccgccgctcgcgtcgtccccgcagctgtcggcgacgacgacgacgcgatgtccaggcgccgctcgacctggctcgcagccagctcgccgcgacgacgacccagcagacggcgcagttcctctcgccgccgcccttctcggcgccgtcgtccccgtgggccaagccgttcgcgcggaacgcgcagtacttccagctcgcgcactcgtcgcccgtgtccccgtcgacgccgaccgggccggtgcacccggccatgccggacctgtctctcggcggccacggcgcgcgcgccgccgccgctgccgaccagagcaggctcccaccgctctcgccgtcccccggccccagagtggagctcccttcaaaccaatacggccagccggcgccgccgacctcggccgccgccgtcgccgccggacttgcgctgccggatcatcagaacgcggcgagcctcgaacagatgctgcaggagctgcacgacgtcatcaaggtcgaaccgcaggcgctggtcccggccagcggcggcggcgctgcactggagcggcatgattgcggagtttcagtcccagagagcagaatcagcggcctgcagcgtcggggtgacgacatggacacgctgttcggcctggtgcacccagcgctcggcgcgccggagacggcgccggcggccgctctagagtatccctcgaggggcccaagcttacgcgtacc

SEQ ID NO: 857 - DNA, 1176 bp, Zea mays
tagcgagggggagggcgagggcgagggcgactgcgaaatgatgctgcaggaacagatggactcgctggtggccgacgacgtcagcagcggaggagggtcgcctgaagaaggggccatggacgtccgcggaggacgccatcctggtggactacgttaagaagaacggcgagggcaactggaacgcggtgcagaagaacaccgggctgttccgctgcggcaagagctgccgcctccggtgggcgaaccacctcaggcccaacctcaagaagggggccttcacccccgaggaggagcgcctcatcatccagctccacgccaagatggggaacaagtgggcgaggatggctggtcacttgccagggcgtactgacaatgagatcaagaactactggaacactcgaataaagagatgtcaacgagctagccttcctatttatcctgctagtgtatgcaatcaatctacaaatgaagatcagcaactgtctggtaattttaacggtggcgagaatatatccaatgatcttctatctgggaacagcctttatctgccagattttaccagtgacaatttcattgcgaacccagaggctttatcctatgcaccacagttgtcagctgtttcaataagcaatttgctcggccaaagctttgcatcaaaaagttgtagcttcatggatcaggttgaccaagcggggatgctgaaacaatctggctgtgtgcttcctgcattgagcgatgccattgacagtgtgctttcctcagctgatcatttttcaaatgactctgagaagctcaggcaggctttaggttttgattatctgaatgaagccaatgctagcagcaagagtattgcacctttcggggttgcacttactggcagccatgcctttttaaatggcaatttctctgcttctaggcccacaaatggtcctttgaagatggagctcccttcactccaagatactgaatctgatccaaatagctggctcaagtatactgtggctcctgcaatgcagcctactgaattagtagatccttacctgcagtctccatcagcgaccccttcagtgaaatctgagtgtgcatcgccgaggaacagtggtcttttggaagagctgcttcatgaagctcaggcactaagatctgggaagaaccaacaatatgaaatctcgtgac

SEQ ID NO: 858 - DNA, 415 bp, Zea mays
atgaagccctacggaggtggtcgtgagttgtcagcgtgggtgaggaaagggccgtggacggaggacgaggacgaggtgctgcggcggcacgtcatggagaacgggccccgggagtggagctccattcgatccaaaggcctcctcccgcgcaccggcaagtcctgccgcctccgctgggtcaacaagctccgcccggacatcaagaagggctgcaagttctcggcggacgaggagcgcgtggtcatcgaccttcaggcgcagttcggcaacaagtgggccaggatcgccacgtacctgtccggccgcacggacaacgacgtcaagaacttctggagcacgcggcagaagcggctggcgaggctccagcgtgcgccggggccacgccggaggcccggcggagcttcttcctcgcgcg

SEQ ID NO: 859 - DNA, 1603 bp, Zea mays
aaagcaggctggtaccggtccggaattccccccggccccgcctccctgactcacctgcaaaaaccacttgcaaaccacacaaaccgaaaccgccagctcccctgcctccatttttagcaacttttcccttcaatctcccgtcgcagtcacccttcttgcacccccgcgcagcttccgacacctccgaccttctctggcggcgccccgccgttggacgctcatggagaagagcccgggcgccgcgccgacatcatcgcccgaggaggaggtggcggcggatggccgcgggcacgttgaggacgcgacggggcagaaggagcaggcgacgccggtggtgctcaagaaggggccgtggacggcagcggaggatgccatgctcatggaccacgtccggcaccacggcgaggggaactggaacgcagtgcagagggtgaccggcctgctgcgctgcggcaagagctgccgcctgcgctggaccaaccacctccgccccaacctcaagaagggctccttctcccccgacgaggagctcctcatcgcccagctccacgcgcagctcggcaacaagtgggcgcgcatggccgcgcatctgccggggaggacggacaacgagatcaagaactactggaacacgaggaccaagcgccgccagcgcgccggcctgcctgtgcacccgccgccagaggtgcagctccagctcgccctcgccaggcgctgccgctacgacgacttcttcgccgctgccgtccccgcaggagctgtccggtgtccaggcgctggtgggcgccgccgcctcggccgggtacgccagctcccgcccggcgcccctcgacctggctcggcagctcacccagacgacgaaccagcagacggagactgtgcagttcctctcgccgccacccttctcggcgccgtcgtccccgtgggcgaggccgttcgcccggaacgcgcagtacttccagctcgcgcactcgtcgtcgcccgtgtccccgacgacgccggacctgtccctcggcttacggcgcgcgcagcgccggcgccgaccagagcaggctcccgccgctctcgccttccccttgccccagagtgggggagctcccttcaaaccaatacgcccaaccgacgccgccggcttcggccgccgcccccccacttggaggtgggggggcagcgctgccggatcatcagaacgcggcgagcctcgagaagatgttgcgcgagctccatgacttcatcaaggtcgaccccccggcgctggtcccgcccagcggcggcggcgctgccctggagtggcatggtgggggaggggagtagtccatcccgtgtgtgaaccattttttttcgctttttccctttatttttggatccccgcgggagtagggagttcgatttgttgctttgcggggggaagagaacaaatatgctcatgattactgtgtgaactggcagattagcgtgacccttttcttttgtggttccaaaatctccatttgttttcacttgctacgtgccaccgcccaccggcttcttcaaaagctaaacaatttctgatcttcatcgcggtgtcaccatctagttttaatcggcgtttcacttacttgcc

SEQ ID NO: 860 - DNA, 1954 bp, Zea mays
gggtacctcgaggccggccgggccgcacgagaccattacctagaacatcctaatcgaaaaaaaagtccaaacgctgcccccaccctctcggcctccgccaccgccgcggtccttccctcccctgcccaccgagtagatttgaggatctccagctttttgaggacaatccagttttcgtcgaagttcaaaatgacggtggtggaggcgggggaagtgttgaacttgaaggtgggcgagaaccctctactggaggatgaggccaagacggggtacgtctcgcccgacgaccaagacggggagaccgccagcgaaaaacccagcggcgcgccccagctgaagaagggcccctggagtcccgatgaagataagcttctcaaaaattatgtcgaggcacacggcgaggggaaatggaacaaggtgcagcgcaactccgggctcaatcgctgtggcaagagctgccgcctccgctggaccaaccacctcaggcccgatctcaagaaagggtctttcgacaatgaggagatcgacaagattttgaagttttacctcaagtggggccccaagtgggccaagatagcctcgcgattgcctggtcgcacagataatgaaataaaaaacttttggaataccagaataaagaagactgagaaacagggtttgcctatctatccggaacatgtgctttctcaggttaagcaaccgcaacaagacatgaactgtgaaactcctggattgtcacatggcaagaaacggataagagagattgagattcatgatcttatggatgtcaaaatcttatttcagcaccttgactatcataaggatctagtggttccaacaaaacctttgaaacgccgtgcatctattggtagtctgaaaatttctggtgagactaaggaaacctattgttccactgatttgaactatgtattggcaaggagtgagtcggtgcctactggtagtgccattgccagtggttatccagtcgagctcccttcagtccaaagttccagctctaccctaagtaatgactggttgcttcaatgtgtttcggcttctgttgaacaacagattcatagctccattcaatctacagaaaccatttcatcgcaaaccactggcctgctccccacaatgtctgaaatatcttttgaaacactgattccaatggtataccctatgattcattcttttggctactctgaacatgaaagctctccgaatactgatattcaagctgcaaacttatctttaggttcagatgatgttagccagtattatcaagttgctagtttttttgatcctggggtccctgatacagagctaggggcaagtttcttcaatgacacaccaccagaaacaagttttttgaaccaacagaagcaagtatcttgaatggtacaccaccagaagcaagtatcttgaatgatatagcactagaagcaagtttcttgaatggtacacaactagaagcaagtttcttgaatggtacacaactagaagcaagtttcttgaatgataattcgaaggaccattcacatctttactgtcaggagcctaagcctgattgatggaggccaatggtttgatctgtgtcgcaagcccaggtccgtgagcagcagttctccgttgcacaatcagggtcagtgcgacaaccatgattagatactcttgtcttcctagcattttgttaaggtcacagagccttgtgttgtttcaggcagtttgtgtataaagacataccttgagtgcttgaacttcatattcatttattttgatgtgctgcgaccatctgaactgaaatttcgttctttgatgtgatgtgatttatcgggaaaaaaaaaaaaaaaatgctgcccttgccgttctcctgcagtttcgagcttacttcctacatgcttcttgggtgtagtgggaatgtgctccctgcatcctggaactgatctgctatgcc

SEQ ID NO: 861 - DNA, 1449 bp, Zea mays
gatagcttctgctcaggttgctgacccaatcagatggccaaattcaccgtggaggcttcttcaggtcgcatgggatgaaccggacttgctgcagaacgtgaaatgtgtgaacccatggctcgtggagatcgtatcaagcgttccaccgatccacctgggaccattttctccacctaggaagaagctgcgggtgccccaccatccggacttcccgttcgacggccagctgttgaatccgattttccacggcaacccactcggtccgagcaacggcggcggtgctcttcgctgtttctcggacatcgctcctgcaggcatacagggagccaggcatgctcagttcggtctaccactaacagaccgccagcttaacaagctgcacctcggtctgttccaaggcggcggttttaagcggcggcttgacgctatcactccaccatgccctatatccaggggctttgtgatcggcagtgcaccggtcgacgagagcgtctcttgcgtgctgacgatcggcacgccacgggccgcagagagatctgacgacaggaagaaaccacatctaatgctgttcggaaagcctatccttaccgagcagcagatgagctctagagggtcaagggaaacactctcccctgaggccactgggaacagttccgatggcagtgttcagaaaacgggaaacgtatccgatggctccggctcgtcgatctgcatcggttcctcgtcccgaggccgcgaggcttctaggctcgggttcgaatttgaagccgggcactgcaaggtatttgtggagtcggaggatgtcggtcgcaccatcgacctgtccgtctttggctcgtacgaagagctgtacggtcagttggccgacatgtttggaatcgagagggcagaggtaatgagccacctttgttaccgtgatgctgctggcgctgtcaagcgtactggcgacgagccgttctgtgacttcatgaaagtggcacggaggctcaccatagtagagagcaccgaggggaggctgcagaaacctctcgtcgagtacatggcttgattgcatgactgttcgataaggcactctgaagcttgaggaagactgaagcttggagcgaatatgttttcgtttgcgtttgtctgccgtgaagcggaatcgcgatgtctgtctcgtcgtgtgaaagaaactcgtgtatcggattttcgtctgtcgtgacttggtcgttagaactctgtcgtggtcagttgtgttgcgcttgcgcttgggtcgaagttgatagatggcctctttgatgaactagcttggaataaagttcgagttgtggttagggaatgccagtgccatggcaattcagttgtcgttgtcgatttagttaaaaaaaaaaaaaaaaaagctgcagtttgatagcacttgccaagatatgttgaacttatcgtggttatgttcatttcctcagcgtg

SEQ ID NO: 862 - DNA, 2484 bp, Zea mays
atgacgcataccgaaattcacgggcctcaaacttccacacagctccacgcatacgtcgatccactgctccgtagctcagttacacacgacacccgctcgtcttcgtcagttcgtctcctccacctctgtatccctctcactccaccggccgccggccctcgcatcggcgcgttcccaatgatcacatttgcggacctgacggagccggccgccgccggcgccgagcggtgcgtggaccggcaactgtggctggcgtgcgcgggcagcatgtgcaccgtgccgcttgttggcgccagcgtctgctacttcccgcaggggcacgcggagcacgcgctcggtctcgacggtgcggccgacctctccgcggcgcgcgtaccggcgctggtcccctgccgcgtcacggcagtgcgctacatggctgatccagacaccgacgaggtcttcgccaggatccgcctcgtcccgctacgcggcggggaggcgcacgcgggtggcctcgatgacgatgtggccgcggcggacgagcaggagaagccggcgtcgttcgccaagacgctgacacagtccgacgccaacaacggcggcgggttctccgtgccgaggtactgcgcggagaccatcttcccgcggcttgactacgccgccgacccgcccgtgcagaacgtcgtcgccaaggatgtgcacgggaccgcctggaagttccgccacatctaccggggcacgccgcgccggcacctgctcaccactgggtggagcacgtttgtcaaccagaagaagctcatcgccggggactccatcgtgttcctccgcggtgacagcggggacctgcacgtcggcatccggcgcgcaaagcgtgggttctgcggcgctggtgggggcggaggcgacgaggcccctacgcccgggtggcatcattacgccggccttatccgaggtaatgtgagcccttgcgcggctgccaaggcacggggcaaggtgcgaccagaggacgtggccgaggcggcgaggctggcggctgccgggcagtcgtttgaggtggtgtactaccctcgcgcgagcacgcccgagttctgcgttcgcgccgccgcggtccgcgcggcgatgagggtgcagtggtccccagggatgcggttcaagatggcgttcgagaccgaggactcctccaggatcagctggttcatgggcaccgtcgccggcgtccaggtcaccgaccccatccgctggccgcagtcgccgtggcgccttcttcaggtgacctgggacgagccggaccttctgcagaacgtgaagcgggtgagcccatggctggtcgagctggtgtcaagcatgccggccatccacctcgcctccttctcgccgccgcggaagaagccccgcatcccagcgtaccccgagttccccttcgaagggcagctccttaacccggcgttcccgcccagcccactgccacacggccagcaacaccaccacaatttccttcacgcccacccaccgtcgttcttcccgttcccggacggcagtgctcctgcagccatacagggagccaggcatgcgcaatttgttccatctttatcagatctccaccttatccacctgcagtcgagcctgctgtaccctgggctccgccgtcccgaccatgtcggtccgacgatccctatcccgtcgggaatcagcaccgacctgaccatcggaggcgcaccggcgcgcgacggcgtcccgtgtgccctgtccgtcggtgccagcaagcagaaccccgacgccgtcaagccggcggggctggtgctcttcggacggaccatactaaccgagcatcagatgagcctcagcagctccggcggcgccacctccccagcggcgactggtaacagctctctgtgctggaccgccgagaagggccccaatgtctcggagggctcgggctcgggctcgggctccggcgtcatccagaacagcccgaccggcaagaacacgtcgtcggagaggctgccgtggttcggggacggcagcagccagcaggcctccgagcccggtcttgagcccggacaatgcaaggtgttcgtcgagtccgacacggtcggccgcaacctcgacctgtcggcgctgggctcgttcgacgagctgtacggccgcctgtccgagatgttcggcgtcgagggcgcggagatgcggagccgcgtgctgtaccgcggcgccaccggtgaagtgaggcacgccggcgacgagcccttcagaggagacagcaaccgcagtgagggaggagaaaaggtggccgtcggcgaggttgagtggccgcacgggggagcttcagccccccgccgtgcgggtgatctccggctggccgccacgcgggcgagcgtggggggagcttgggccctgctgccgcgcgggcaacctctggcggtctggcccacgcccaccatcgcgcaaggcgagcgcgggggaactccggcagtcaagcccccagcggccctcctcgtcgcttag

SEQ ID NO: 863 - DNA, 2807 bp, Zea mays
gccggcgaggccggccttcagtcatcaccacaacaaggtagaggcgtccgaggcctcgccataattccaacccactgtgtgtgccgctgtagcagcgcagcgcagcgcgcgcgccaccaccgtcaacctcctgatctccccgcctcgccgccgtcgattcttcgccgtcttcctggggctcgggggcagccggagcaagcttgggggggtggtgtcctcggaccgacgacagagtcgttgcccgcgaagatgccggccctggtgtacattcctactccgctttgcccggtgccagagcgtttctcccggagtagcggttgcgccgcctcatgatctgccaattggaacccctgggcgtgcgcagaggaggttgctctgcagctggacagtgatcgcgtttggtgggtgtggcggcggtggaggaagacgacacgacgaagacgaggaggtcaggaggccatgaaggaggcgggcgaggagaggtgccttgacccgcagctgtggcacgcgtgcgccggcggcatggtgcagatgccccccgtgcgctcccgtgtctactacttcccgcagggccacgcggaacacgcgcacggcggcggcggcgccacggacctcgccggggcgcgggcgcgacctctcccgccgctcgtgctctgcaccgtcgccggggtgcgcttcctggccgatccggagaccgacgaggtcttcgccaagatccgcctcgtgccggccgcgcccggcgaggtggagttcggagagccccgcgagttcggcatcgaccccgaggacgcccgggagaagctgtcctccttcgccaagacgctcacgcagtccgacgccaacaacggcggcggcttctccgtgccgcgctactgcgccgagaccatcttccccaagctcgactaccgggccgacccgccggtgcagacggtgctcgccaaggacgtgcacggggaggtctggaagttccgccacattttccggggcacgccgcgccggcatttgctcaccacgggatggagcgcgttcgtcaaccagaagaagctcgtcgccggggactccatcgtcttcctgcgcaccgagcatggcgagctgtgcgtcgggatacgccgtgccaagcgggtgtcctgtggtggcatggagtgcatctctggctggaacgccccggtgtacggggccttgtcggcgttcttgaaggacgaggaaggtaagatcactaagggtcctggtgggtacatgagaggcagggggaaggtggagatcacggacgttgttgaggccgcaagcttagccgcgagcgggcagccatttgaggtggtgtactacccgagagctagcactccagagtttgttgtgaaggctgcatcggtacagaacgcgatgaggaaccagtggtgccctgggatgaggttcaagatggcatttgagacagaggattcgtcaaggatcagctggtttatggggacgatagcttctgctcaggttgctgacacaatcagatggccaaattcaccgtggaggcttcttcaggtgtcatgggatgaaccagacttgctgcagaatgtgaaatgtgtcaatccatggcttgtggagattgtatcaagcattccaccgattcacctagggacattttctccacctagaaagaagttgcgggtggcccaacatccagactttccatttgagggtcagctgttgaatccaattttccatggcaacccacttggtccaagcaacagcccacttcgctgtttctcggacatcgctcctgcaggcatacagggagccaggcatgctcaatttggtttacccctaacagactaccagcttaaccagctgcacctcggtttcaaccggcttggtgctatgactccgacgccccgtatatccaagggttttgtgatcagcagcgcaccagccagtgagagtgtctcttgcttgctgacaatcggcacaccacaggccacagagaaatctgatgacataaagagaccccacataatgctgttcggaaagcctatccttactgagcagcagatggattctggaggatcgagggaaggcctatcccaagaccgcaaggcttctgagcttgggctagaagacgggcactgcaaggtgtttatggaatcagaggatgttggccgcaccattgacctatctgtctttggttcgtacgaagagctgtacggccagttagcggacatgtttggaattgagaaggcggaaataatgaggcacctttgctaccgtgatgctgctggtgctgtcaggcatactggtgaagagccgttcaatgacttcatgaaagtagcacggaggctcaccattatagagggcacggaggggagaccgcagaaacctctcgtggaatacatggtcgagcgggcttgattgcatggtggttcggacaaggcaatctgaaacttgtgcaagactgagcttagagcgaagtaactgctgtgtgttttcatttgtgtttgtctgccgccgaagcagaatcgcgatgcttgtctggtcgtgtggaaaaccttggtgtacgcttcgtgacttggtcgttagaactctgtcgtggtcagttgtgttttgcttggtcgaagttgatgaataacctctttgacgaattagcttggaataaagttcgagttgttgtgttatggtaagtgccatggcaacatggcaattcagttgtcactgtcgatttagttaaaatgcgtgtatctgttattacagtttgacaacacttattcatttcatcagcatacttgtggccggttatctatcgccagtttgggaacaaaaaaaaa

SEQ ID NO: 864 - DNA, 2566 bp, Zea mays
ttatcgatgacaaattgttaaagatcccccacgcaacaaggagaggtgtccgaggcctcccacctcataattccaacccactgtgtgtgccgctgtagcagcgcgcgccaccaccgtcaacttctccccacctcgccgccgtctagatttcgtctcctgggctcgagcaaccgaagcaggcttggggtgttctcggagagaatcgttgcctcggccgatgccggccctgatgtaggtttctgctctgctttgcccggtgccaacgtctctcccggagtagcggttccgccgccccatgatctgccagttggaacacatgggcgttcacggaggaggttgctctgctggacagtgaccgcatttggtagcggtggaggaagacgacgaagaggaggaggagtaggccatgaaggaggtggccgaggaaaggtgccttgacccgcagctgtggcacgcgtgcgctggcggcatggtgcagatgccgcccgtgcgctcccgtgtctactacttcccgcagggtcacgcggagcacgcgcatggcggcggggccgcggacctcgccggggcgcgagcgctcccgtcgctcgtgctctgcagcgtcaccggggtgcgcttcctggccgatccggagaccgacgaggtcttcgccaagatccgcctggtgccggtcgcgcccggcgaggtggagttccgagagcccgatgagttcagcgtcgaccccgcggacgcccgggagaagctttcttccttcgccaagacgctgacgcagtccgacgccaacaacggtggcggcttctcggtgccgcgctactgcgccgagaccatcttccccaagctcgactaccgggccgacccgccggtgcagacggtgcttgccaaggacgtgcacggggaggtctggaagttccgccacatttaccggggcacgccgcgccggcatttgctcaccacgggatggagcacgttcgtcaaccagaagaagctcgtcgccggggactccatcgtcttcctgcgcactgagcatggcgagctgtgcgtcgggatacggcgtgtcaagcgggtgtcctgtggtggcatggagtgcatgtctgggtggaacgccccggggtatggggccttgtcggcattcttgaaggatgaggagggtaagatgatgaagagtcatggtgggtacatgagaggtagggggaaggtgaagatcacggatgttgtcaacgccgcaagtctagcagcgagcggacaaccatttgaagttgtgtactacccgagagctagcacaccggagtttgttgtgaaggctgcatcggtacagaacgcgatgaggaaccagtggtgcccggggatgaggttcaagatggcatttgagacagagtattcgtcaaggatcagttggtttatggggacgatagcttctgctcaggttgctgacccaatcagatggccaaattcaccgtggaggcttcttcaggttttgcttgatcacatgtttccaatacttgtatgcaatactgcatttctcttctggtcaatggtcactgagatcagtgttgtcaccttctacaacattgttttccatctccatgtggcatgggatgaaccggacttgctgcagaacgtgaaatgtgtgaacccatggctcgtggagatcgtatcaagcattccaccgatccacctgggaccattttctccacctaggaagaagctgcgggtgccccaccatccggacttcccgttcgacggccagctgttgaatccgattttccacggcaacccactcggtccgagcaacggcggcggtgctcttcgctgtttctcggacatcgctcctgcaggcatacagggagccaggcatgctcagttcggtctaccactaacagaccgccagcttaacaagctgcacctcggtctgttccaaggcggcggttttaagcggcggcttgacgctatcactccaccatgccctatatccaggggctttgtgatcggcagtgcaccggtcgacgagagcgtctcttgcgtgctgacgatcggcacgccacgggccgcagagagatctgacgacaggaagaaaccacatctaatgctgttcggaaagcctatccttaccgagcagcagatgagctctagagggtcaagggaaacactctcccctgaggccactgggaacagttccgatggcagtgttcagaaaacgggaaacgtatccgatggctccggctcgtcgatctgcatcggttcctcgtcccgaggccgcgaggcttctaggctcgggttcgaatttgaagccgggcactgcaaggtatttgtggagtcggaggatgtcggtcgcaccatcgacctgtccgtctttggctcgtacgaagagctgtacggtcagttggccgacatgtttggaatcgagaaggcagaggtaatgagccacctttgttaccgtgatgctgctggcgctgtcaagcgtactggcgacgagccgttctgtgacttcatgaaagtggcacggaggctcaccatagtagagagcaccgaggggaggctgcagaaacctctcgtcgagtacatggcttga

SEQ ID NO: 865 - DNA, 1449 bp, Zea mays
atgaggacggtgaacggggacctctgcgtcggcatccggcgcgccaagaagggcggcatcggaggagggccggagttcccgcaccaccagccgccgggcggcggcggcgggtacgggtacgccggcttctccacgttcctgagaggagaagaggacgacgcggccgcgaggggcaaggccagggtgcgggtgcggccggaggaggtcgtcgaggccgccaacctcgcggcgagcgggcagccgttcgaggtggtctactacccgagggcgagcacgccggagttctgcgtcaaggcgggggcggtccgcgcggccatgcgcacccagtggtgcgccgggatgaggttcaagatggccttcgagacggaggactcgtccaggatcagctggttcatgggcactgtcgccgccgtgcaggtcgctgaccccatccgatggcccaattcaccctggaggcttcttcagaacgtgaagagagtgagcccatggctggtcgagcttgtctcaagcacgccggccatccaccacctcacgccgttctcgccgccaagcaggaagaagctgtgtatcccattgtacccggagggccaccagctcccggcgccgatgttccacggaagccctctggtgggccgtggtgttggcccgatgcgctacttcccggacggcggcactcctcctgcaggcatacagggagccaggcatgcgcaattcggcatatctttaccagatctccaccacctcaccaggctgcagtcgagtctatcgccgcacgcgcacgggcttcgccaccagctcgaccacggcgcgcggccgaggatcgccggcggcctcatcgtcggccacccggcagctcgggacgacatctcgtgcttgctcaccattggcaccgccccgcacaagaaaccatcagacgtcaagtcggccgcggcggcgccggcgccgcagctgatgctgtttgggaaaccgattctcaccgagcagcagatatctctaggctttcggccgctgccggcgccgaagaagagcccgtccgacgacgctgctgagactgagaggacggtgagcaacaactcggatgcctcgagcccagctgggactgcgagtgggagcacgccgtccatcagtggaggcgccccgtcgtcgtgccaggacaacaaggcggcggcgacggcgacggcgactgatgacgacgatctcctcgggcactgcaaggtgttcatgcagtcggaggacgtcgggcgcacgctcgacctctcggctgtcgcgtcgtacgaggagctctaccagaggctggccgacatgttcggcgtcgacagggccgagctgacgagccatgtcttctaccgcgacggcgcttctggagcgctcaagcacgccggcgacgagcctttcagtgagttcaccaagaccgctcggaggctgaccatacaaacggacgcgaggtag

SEQ ID NO: 866 - DNA, 1913 bp, Zea mays
gggcccctcgagggatactctagagcggccgcgaggggcaaggtcagggtgctggtgcggccggaggaggtcgtcgaggccgccaacctcgcggcgagcgggcagccgttcgaggtggtctactacccgagggcgagcacgccggagttctgcgtcaaggcgggggcggtccgcgcggccatgcgcacccagtggtgcgccgggatgaggttcaagatggccttcgagacggaggactcgtccaggatcagctggttcatgggcactgtcgccgccgtgcaggtcgctgaccccatccgatggcccaattcaccctggaggcttctccaggtcggttgggatgagccggacttgttacagaacgtgaagagagtgagcccatggctggtcgagcttgtctcaagcacgccggccatccaccacctcacgccgttctcgccgccaagcaggaagaagctgtgtatcccattgtacccggagggccaccagctcccggcgccgatgttccacggaagccctctggtgggccgtggtgttgggccgatgcgctacttcccggacggcggcactcctcctgcaggcatacagggagccaggcatgcgcaattcggcatatgtttaccagatctccaccacctcaccaggctgcagtcgagtctatcgccgcacgcgcacgggcttcgccaccagctcgaccacggcgcgcggccgaggatcgccggcggcctcatcgtcggccacccggcagctcgggacgacatctcgtgcttgctcaccattggcaccgccccgcacaagaaaccatcagacgtcaagtcggccgcggcggcgccggcgccgcagctgatgctgtttgggaaaccgattctcaccgagcagcagatatctctaggctttcggccgctgccggcgccgaagaagagcccgtccgacgacgctgctgagactgagaggacgatgagcaacaactcggatgcctcgagcccagctgggactgcgagtgggagcacgccgtccatcagtggaggcgccccgtcgtcgtgccaggacaacaaggcggcggcgacggcgacggcgactgatgacgacgatctcctcgggcactgcaaggtgttcatgcagtcggaggacgtcgggcgcacgctcgacctctcggctgtcgcgtcgtacgaggagctctaccagaggctggccgacatgttcggcgtcgacagggccgagctgacgagccatgtcttctaccgcgacggcgcttctggagcgctcaagcacgccggcgacgagcctttcagtgagttcaccaagaccgctcggaggctgaccatacaaacggacgcgaggtagaagaaggcggcagacaatgaagctctcgtcgcctgtacaaccggggggagctagcgagccgcggcggcgatctcgaaggacgatcgccccttgcagagtgctggtgcagactgcaaagagggcggtgctgctgtcgtgtcggtcgtttcttatcagctcttttgttgcctgcaaaatgaatttaaagaatgtgctttgtcacgctgccacgtcagtcagtcagcacgcagttgctaccgcccaacggtactgttcttttgcacatacttgttctagccctgtcgttgttcctgttgcgggggagccctggcaggcgtgcgtagtgcgagcgccccggatgccgtgccatttcaccagccaggccgcgccgtgctgcttctagcggtccttgtgtgcacggcgtacgttgttcagtgatctttcctggagtgtccaagtactctcgtgcctactgtcccacggtctgcttttcatcctctctaatatatgttcatctctgtacacgagcgaaaagcgtgaacagtagaggaggaagatcactaaacagaaaaaaatataaaattttgtgt

SEQ ID NO: 867 - DNA, 2246 bp, Zea mays
tgacactatagaacaagtttggtacaaaaaagcaggctggtaccggtccggaatttccggaccgtgagaacacgcagctccgtagctcagttacacacgacacccgctcgtcttcgtcagttcgtctcctccacctctgtatccctctcactccaccggccgccggccctcgcatcggcgcgttcccaatgatcacatttgcggacctgacggagccggccgccgccggcgccgagcggtgcgtggaccggcaactgtggctggcgtgcgcgggcagcatgtgcaccgtgccgcttgttggcgccagcgtctgctacttcccgcaggggcacgcggagcacgcgctcggtctcgacggtgcggccgacctctccgcggcgcgcgtaccggcgctggtcccctgccgcgtcacggcagtgcgctacatggctgatccagacaccgacgaggtcttcgccaggatccgcctcgtcccgctacgcggcggggaggcgcacgcgggtggcctcgatgacgatgtggccgcggcggacgagcaggagaagccggcgtcgttcgccaagacgctgacacagtccgacgccaacaacggcggcgggttctccgtgccgaggtactgcgcggagaccatcttcccgcggcttgactacgccgccgacccgcccgtgcagaacgtcgtcgccaaggatgtgcacgggaccgcctggaagttccgccacatctaccggggcacgccgcgccggcacctgctcaccactgggtggagcacgtttgtcaaccagaagaagctcatcgccggggactccatcgtgttcctccgcggtgacagcggggaactgcacgtcggcatccggcgcgcaaagcgtgggttctgcggcgctggtgggggcggaggcgacgaggcccctacgcccgggtggcatcattacgccggccttatccgaggtaatgtgagcccttgcgcggctgccaaggcacggggcaaggtgcgaccagaggacgtggccgaggcggcgaggctggcggctgccgggcagtcgtttgaggtggtgtactaccctcgcgcgagcacgcccgagttctgcgttcgcgccgccgcggtccgcgcggcgatgagggtgcagtggtccccagggatgcggttcaagatggcgttcgagaccgaggactcctccaggatcagctggttcatgggcaccgtcgccggcgtccaggtcaccgaccccatccgctggccgcagtcgccgtggcgccttcttcaggtgacctgggacgagccggaccttctgcagaacgtgaagcgggtgagcccatggctggtcgagctggtgtcaagcatgccggccatccacctcgcctccttctcgccgccgcggaagaagccccgcatcccagcgtaccccgagttccccttcgaagggcagctccttaacccggcgttcccgcccagcccactgccacacggccagcaacaccaccacaatttccttcacgcccacccaccgtcgttcttcccgttcccggacggcagtgctcctgcagccatacagggagccaggcatgcgcaatttgttccatctttatcagatctccaccttatccacctgcagtcgagcctgctgtaccctgggctccgccgtcccgaccatgtcggtccgacgatccctatcccgtcgggaatcagcaccgacctgaccatcggaggcgcaccggcgcgcgacggcgtcccgtgtgccctgtccgtcggtgccagcaagcagaaccccgacgccgtcaagccggcggggctggtgctcttcggacggaccatactaaccgagcatcagatgagcctcagcagctccggcggcgccacctccccagcggcgactggtaacagctctctgtgctggaccgccgagaagggccccaatgtctcggagggctcgggctcgggctcgggctccggcgtcatccagaacagcccgaccggcaagaacacgtcgtcggagaggctgccgtggttcggggacggcagcagccagcaggcctccgagcccggtcttgagcccggacaatgcaaggtgttcgtcgagtccgacacggtcggccgcaacctcgacctgtcggcgctgggctcgttcgacgagctgtacggccgcctgtccgagatgttcggcgtcgagggcgcggagatgcggagccgcgtgctgtaccgcggcgccaccggtgaagtgaggcacgccggcgacgagcccttcaggtaa

SEQ ID NO: 868 - DNA, 741 bp, Zea mays
  misc_feature (1)..(1): n is a, c, g, or t
  misc_feature (358)..(358): n is a, c, g, or t
nccccaccccatattaaattaaaccacaacccaaagtacactccaacactctttaataattatattaatttttctccccccccccccgaattgggtaccgggccccccctcgagtcagctacctaggccccccccccaattcatgcttgtctttgccaatattctaaagtttgaattttcatcgcaacaggttagttgggatgagcctgatttgctacataatgtgaagcgagtgagcccatggttggttgagttggtatctaacgtgccaatcatccatctggcagccttctctccaccaaggaagaagcttaggttcccccttgacgttcagtttccgataccatcgttttcaggnaacccctttgggtcttctagctctagcagccccttttgttgtctctctgataacgctcctgcaggcatacagggagcccaggcattctcaaattggaatatctttatcagatcctccaccttaacaataagctgcagttgaggttgcttcccactaaagtccaccagcttaatttgcacgccgggatttctaatgctaagagtaaagaaagcctatcatccttgctctccatgggaaattctaacatgactttggagaaatctgatcatgtcaagagacaccattttttgcttttccggtcaaccgatactccccgagcaacaaatctctaaatcctctagtgatgtccccaccggatgatgagaataaggaaaagaagaaga

SEQ ID NO: 869 - DNA, 2262 bp, Zea mays
atgtctcccgaagcctgcgagctcacgctcgcgccgcggatgcccgcatcgcaggccggtgccggtgccggcgccgagcccgagaccaagggatccgtgcacccgcaactgtggtacgcgtgcgcgggccccacgtgcaccgtgccgcccgtcggcaccgcggtgtactacttccctcagggccacgccgagcatgccggcgccgccgccgacgccaacctgcacgccccgcctttcgtgccgtgccgcgtcgcgggcgtcaggttcatggctgagctcgacaccgacgaaatcttcgtcaaaatacgcctcgacccgctccgctccggggagccgctgacggacgtgggcgaggcccaggtggtgaacgacgaggccggccagcggcagcccaccaggccggtgatttcttccgccaagacgctgaccaagtccgactcctacagcggcggcagcctctccgtgcggcgcacctgcgcggaaaccatcttccccaagctggacaagagcatcaaacggccccagcagttggtctccgccagggacgtgcacggcgtcgagtggacgttccgccacgtctaccggggcaccccggagcggaacctgctcaccacagggtggagcgacttcgtcaacagcaagaagatcgtcatcggcgattccgtcgtgttcctgcgcgaagaggacggcaccatccacatcggcctgcggcgcgccgagcgcgcgtcccggcggaacgcctacgggcgccagctggtgcggggcaacgcgagcggcacgggcgccgccgcggacggcgtcctccgagcggaggacgtggtcgcggcggcggtgacgctggccgccgccgggaacccgttcgaggtggtgcactacccgcgggccacagcgccggcgttctgcgtgcgcgtggccacggtcattgaggccttgcaggtctcctggtgccccggcttgcggttcaagatggcgttcgaggcaaaggacctgtcccggatcagctggttcatgggcaccgtcgccggtgtcgggccggccgatcccgcccggtggccgctgtcgccctggcgattccttcaggtgacctgggacgagcctgagctcgtgcggaacatgaaccgcctgagcccgtggcaggtcgagctggtggcgaccatgcccaacctgccgcacttcgcggcgccgcctacgccgacgccgccgcgcaagaagccgcgcatgccgacgtacaaggagtaccaatcgcagggccggcaacttttcgatcccgttttcccgctcaacaacccactcccactgccacacccacaccaccaccctgcaccaacccacgactggaactgccacggtttcgtccattgttcctccttccccttcccggacagcatcgctcctgctgctgccgcaggcatacagggagccaggcatgcgaacttcgctcagttcttattttcggatcacctcctcagcaacctgcggcgaagcctggtgttgggtggcatccgccagtacccaggcgatcaccatgccgctcccgcgccacggatccccatccccaccgacgacgtgaagactggcagcgaaacgccccgctctccatcacatgcgaccaagaagcgcgacggagtcaagccgccggggataaggctcttcgggcaggagatactgaccgaggagcagatgaaaggcagccacgatgggaaagcgaccaacaacacctctggtcgctctggagcgcccgagttcgggctggagcccgggcagtgaagagtgttggtggagtcggtcgccttcgtcggatcagctagctagcgctgcagccgcagtgtagcttagaggagcacgtcggcgacgagactttgagtgcgtatgtgaaataaccggggaggatcgatcgaggtaccgaacgaatgacgctggcaggcagcgaccacacgccgagaaccgatgatcgaccagcagatatcggctgcgactgcgatattgtagagcgctatattcataggatgcgatagcgatacagccgaatgcaccaccgagcttgcggccacgtacgtttgaggtctcttcctggatcagtcttagagagtttacagcttaagctgatgcggttattcaattcagttattacgctgtgtttttaaggccactttggattgctgggttttttttatttctttcttatgttctctacggttttatgttcctgcagacgattcctataaattttgtcctataaaaaacaaaaaaaaaaaaaaaaaa

SEQ ID NO: 870 - DNA, 2531 bp, Zea mays
  misc_feature (2497)..(2497): n is a, c, g, or t
atggagcgggagcgggagagtgacaggtgcctggacccgcagctgtggcacgcctgcgccggcgggatggtccagatgccggcggtgcactccaaggtgtactacttcccgcagggccacgcggagcacgcgcagggccccgtggacctccccgccggccgggtccccgcgctcgtcctctgccgcgtcgccgccgtccgcttcatggccgatccggacaccgacgaggtcttcgccaagatccgcctggccccggtccgtcccaacgagccgggctacgccgacgacgccattggcgccgcggcggcgtcgggcgcgcaggaggacaagcccgcgtccttcgccaagacgctcacgcagtccgacgccaacaacggcgggggcttctccgtgccgcgctactgcgccgagaccatcttcccgcggctcgactactcggccgacccccccgtgcagaccgtgctcgccaaggacgtgcacggcgtggtctggaagttccgccacatctaccgcggcacgccccggcgccacctgctcaccaccggctggagcaccttcgtgaaccagaagaagctcggcgaggcggactccatcgtgttcatgcggacggagaacggggacctctgcgtcggcatccggcgcgccaagaagggcggcatcggagggccggagttcatgcaccaccaccaccagcagccgcccccgccgcagggcggcgggtacgccgggttctccatgttcctgcgaggggaagaggacggcggcaagatgatggccgcggccgccacgagggggaaggccgccagggtgcgggtgcggccagaggaggtcgtcgaggcgcgctaacctggccgtgagcgggcagccgttcgaggtggtgtactacccgagggcgagcacgccagagttctgcgtcaaggcgggggcggtgcgcgccgccatgcgcacccagtggtgccccgggatgaggttcaagatggccttcgagacggaggactcgtcccggatcagctggttcatgggcactgtctccgccgtgcacgtcgctgaccccatccgatggcccaattcaccctggaggcttctccaggtcgcctgggatgagccggacctgttacagaacgtgaagagggtgagcccatggctggttgagctggtgtcgaacatgccggtcatccatcacctcacagccacgcccttctcgccgcccaggaagaagctgtgcgtcccactgtacccggagcttccgctggagggccagttcccggcgccgatgttccacggaagccccctcctcggccgtggcggcgccggtggcccgatgtgctacttcccggacggcactcctgcaggcatacagggagccaggcatgctcaattcggcatatccttatcagatctccacctgaacaagctgcagccgggcctgtcaccgcacgggctccaccgccagctcgaccacggcgtgcaggtgcaggtgcagcagccgaggatcgccgccgggctcatcgtcggcggccacccggcggcccgagacgacgtctcgtgtctgctcaccatcggcaccccaaagagcaagaagccaccgtcagacgtcaagaaggcgtccacggcggcggcaccgcagctgatgctcttcgggaaagcgatcctcaccgagcagcagatatcgctaggcggcggcaatgtcgtgccggcgctgctggcgaagaagagcccctccgacgacgacgacgacgtggccgagaggacggtgagcaactcggacgtgtcgagccctgggaggagcaaccaggacggcacgtccagtggcggaggcccggcggcgcgggcgtgctggcaggaggaggagtgcaacaacagggcggcaggttctgaggacgacctcctcgggcactgcaaggtgttcatgcagtcggaggacgtcgggcgcacgctggacctctccgccgtcgcgtcgtacgaggagctctaccagaggctcgccgacatgttcggcgtcgacaaggccgagctgaccagccacgtgttctaccgcgacgacgcttccggagcgctcaagcaccctggcgacgagcctttcagtgagttcaccaagaccgcccggaggctgaccatactgacggacgagagcagcgacagcttagcgaggtagagtccagtctcaaggagacggcggttcggcagtttcggttgggagtgggaggcgccccggaacgggagcgcgtgcgtgcgtctgatccaggaccaaagatttgtcggactagtagctctacagtagtggagtacgtacgtacaccttgatgctgctgcttctgctgtcagttcaagtggccataaccataatgcagctgcctttggtcacagtgactgatccgggaatgtgttgtgtacatcgggaccgttgatttgcgaacgcgattactgaaagagcttatatttatttttttttggatttttgatataaaaaaaaaaaaaaaaaagcttatcgtaccgncgaacccctccgggggggggggccccggtaccca

SEQ ID NO: 871 - DNA, 1363 bp, Zea mays
ccacgcgtccgggacaggtcgcctgggatgagccggacctgttacagaacgtgaagagggaagaagctgtgcgtcccactgtacccggagcttccgctggagggccagttcccggcgccgatgttccacggaagccccctcctcggccgtggcggcgccggtggcccgatgtgctacttcccggacggcactcctgcaggcatacagggagccaggcatgctcaattcggcatatccttatcagatctccacctgaacaagctgcagccgggcctgtcaccgcacgggctccaccgccagctcgaccacggcgtgcaggtgcaggtgcagcagccgaggatcgccgccgggctcatcgtcggcggccacccggcggcccgagacgacgtctcgtgtctgctcaccatcggcaccccaaagagcaagaagccaccgtcagacgtcaagaaggcgtccacggcggcggcaccgcagctgatgctcttcgggaaagcgatcctcaccgagcagcagatatcgctaggcggcggcaatgtcgtgccggcgctgctggcgaagaagagcccctccgacgacgacgacgacgtggccgagaggacggtgagcaactcggacgtgtcgagccctgggaggagcaaccaggacggcacgtccagtggcggaggcccggcggcgcgggcgtgctggcaggaggaggagtgcaacaacagggcggcaggttctgaggacgacctcctcgggcactgcaaggtgttcatgcagtcggaggacgtcgggcgcacgctggacctctccgccgtcgcgtcgtacgaggagctctaccagaggctcgccgacatgttcggcgtcgacaaggccgagctgaccagccacgtgttctaccgcgacgacgcttccggagcgctcaagcaccctggcgacgagcctttcagtgagttcaccaagaccgcccggaggctgaccatactgacggacgagagcagcgacagcttagcgaggtagagtccagtctcaaggagacggcggttcggcagtttcggttgggagtgggaggcgccccggaacgggagcgcgtgcgtgcgtctgatccaggaccaaagatttgtcggactagtagctctacagtagtggagtacgtacgtacaccttgatgctgctgcttctgctgtcagttcaagtggccataaccataatgcagctgcctttggtcacagtgactgatcggatgtgttgtgtacatcggaccgttgatttgcgaacgcgattactgaaagattattattatttttttgtatttttgatataactaaggaaaaaaggttcttatcgatcccgtcgacccttcgaggggggggcccggtac

SEQ ID NO: 872 - DNA, 2256 bp, Zea mays
cattgggtacctcgaggccggccgggatattttaaaaaaacctcgtagactatgtaaaattatactggggaaggagagcagacaccgacagcggagggaagtaccgggaaggaagaaccgtcgccgcccagcgacatgccatggcagccatcgccgctcttcgccgtcttccgccaacaacgcctcgcctcctcctgggccgccgccatcgctggccacgcgcgctgcggtcgccacgccgccgcacttaccgtcttccgccgcgttctccgagcccaccccgccgtcgctgcctccgaccagttcgcctatgccgccctgctccggtgccgcgaccgccgcctcgcgtaccagatacatgcccaggcgtgccgtcgtggcctgaccgcctccaaccccgtcctcgcttgctccctcctcatcttctatgccgactgcgaggagtggaacggcgccaccagggtgttcagcgaaatgccgtgcccagacaccgtgtcctacaccgccatgatatccgccctcctccgcgccggggactgccacggggcgctcgcgctctacccgtgcatgctcccactttgcgcacccacccagcacaccttctccaagctgctcgcgccctgcgcctccatgcgcttgcaccgccacggcagccagctccacgcgcagctcctccgctggggctgctggggcccccacctcggcctggtcctcaagaccgcgctcgtccacatgtacgccgcttgcggcgccatggtctccgcacgcgccgtgctccacgccactcccgaaaccgacgtcgtgctctggacggcaattatcaccgcctacacgcgtcgcggccagctccatcgtgctctgctggcgttccgtgacatggaacgctctgctgtgcttcccaatgccttcacctacgcagcgctcatcgccgcctgctccgcggaccactcgctgcacatcggacagcagctccatggccgcctcttcaagtctggtctggagcacgacacctctgcttgcaatgcgctcctcgacttgtacagcaagtcctccgcacgttccctcgacttgctgcttgctttccacgcggctgacatgcccaacgtggtgacctggacttccttcattgctggactgatgcgccatggcagggaacaagaggcgcttgcggcatttgctcgtatgcgggctaccggagtgaagcccaactccttcaccctgtccactcttctgaaaggctgcacctccgcacatgcatgtctgcacgctgcaaagatccatgcctatgtgctcaagaccagttcggagtcattggacgcggctgccggaaactcgtttgttgatgtgtacgcaaggtctgcaagaatggatgacgcgtggaaggtggctaccacaatgtccttcgtgagggacagattcacatacacaagcctggccaaagggctgaatcagatggggcttcaccacagggcactcggcatgatacttcacatgttccacgaggaggttagtatcgacggtttcagcctagcttgcttcctttctgctgctgcgacattggcatccatagagtccgggaagcagctgcactgctgtgcagtgaaattgggattgagcggtcaggtatctctctccaacagcctcataaacatgtacagcaggtgcaagagtctggaggatgctaagagtgttttccagtcaatcagggaacccagtgtcgtgtcgtggaatgctataatctttgggatggcattcaacggctcttacactgaagcgttgtcagtttttgaagacatgattctggctggagctcagcctgatggggtcactttcacagttgtgctttctgcctgcagccatggtggcttagttgacattggcatcaaacacttcaactctatggcgaatatgtttgatgtccccccacaaaagagccactatacattgttcctggatatgctaggacgatcaggccgctttacagaggtggcacacaccatcgaggccatgcccgtccagccagacttatcaatttacaggaccctgctggtatattgcaagttccacaatgaaccggtggttggtgaatatattgccaagaaggcactagagttggatccatcagattcagtgtcacggaatacactttcaggcatccgccgtgctcctcggatacaagatcatgacgaacagatatatttgtgggatgaagagggatgcaggcatccaagttctgtgctgccgatcaattgctga

SEQ ID NO: 873 - DNA, 1921 bp, Zea mays
aacctctcagaactcagaaggtttctttgtgcctcagacgacccatcatcctccgcataaccccatcgacgtcgatggcctgcatgtacatcaacggtcactgccttgtccagtaacacgtccgagacgccgccatggcggcgggcaacaagttctcgtcgtaccacctcgccgcggccctccgccgcgagccggaccccgccgcggccctccgccgcgagccggaccccgccgccgcgctccgcctcttcctcaaccctcccgcatccgccaccccgttccgctattccctccgctgctacgacctcatcatctccaggctcgccgccgcgcgcctcttcccggccatggagtccgtcctctcgcgcctggcctcctcctcgggtccccggccccgcgagcagctcctctgccgcgtcgtctccgcctacggccgcgcccgcctccccgccgccgcgcgccgcgccttcgcgcacccggccttccctgggccccgcaccgccagggctctcaacgccctcctccacgccctgctcgcctgccgcgctcccctccgcgacctcctcgccgtctgccgtgacgctgggaccccgccggacgcgtgcacctataacattctcatgcgggcagcggctgcgtccggctcccttggccacgcacgccacctgttcgacgaaatgctgcgacggggcatcgcgccgactgtagtcactttcggcaccctcgtcgccgcgctgtgcgctgctggccagctggaagacgcgttcgaggtgaaggaagtgatggttcggcagtaccacgtgttgccgaacgtgtatgtgtatacaagtctgatcaaggggctctgtgagaaaggggacgtggatgctgcgatggcgctcaaggaagagatggcagggaaggcagatcttgtgctggattctgctgtgtatgcgacgcttgtacgggcgttgttccaggtagggcgaaaaggtgcggtagttggattgctggaggagatgaaggggagtggggttgtggctgatacggtggtgtacaatgctatgctcgcaggcttttgtgaggatgagaaggatcttgctgctgcgttcgctgtgcttgacgatatgcagaagaatgggtgcaaggcggatgcggtgagctataatacattagttgcagggttgtgcaagctgggccggtggcgggatgcacatgaattggttgaggatatgccaaggcaggggtgccatccagatgtggtgacctacagaatgctctttgatgggatgtgtgctgctaaggagtttcttgaagcaaaccaggttttggatgagatggttttcaagggttttgcgccaagcaacgatggtgcacagaagtttgtccaggggattgagaaggaaggagatgtggtattgctagagtcagtgttgtgccgactagcgaaggtgaatgctttggtgccaagtggatgggaaaaagctgtaagtggtgcgctgaatgatcccacagagttgaggctagagaagcagcttgactctttaagaattgcttgattagacaccatagtggatttgatcaatacagtttgagtagcaaaaaaatggcaagcatgatttttaaagaaatcaatttgttcatctgttatacaaggctgccttgcaggagtcttacccaattcaggttagtttcttgcaggtagtattattaaagtcagagaaagattaaaatggaatctaaggtgtgcaacttattcaattgaagttaatttgccataagattggaatataagatggatctatggcaaaaaaagaatattcgtgtttgcaagtacatgatcgtatatattctagttttttggtatgcttctaaatatgttgttattttgttcccttgctgacaataatgtgatcttttgaatacaaaaaaaaaaaaaaaa

SEQ ID NO: 874 - DNA, 2229 bp, Zea mays
gcgcgagcgccggcgcctacgccaggtgcccaggcctccgtcggtcatttcgccaggcattcgtcgcgggctcttcgccggcgacgagcacacccaccaaacagattctcgtgacagtgcctccctggttgcctttcgctgaagttactgaatctgaaatctgaccatcatgaaccaagttgagggttggtcctttacgagcatgttataatgggagagaacggagttcagctgacactgacctccactttgaagagcacaggcaagccacggatcaatgcggacgggctgaataatggatcacatactaccaaagagaagcatgaacacggtggcactttccaaccatcaaaaggccagaagcagcagctgtgcacaacatgtgcaaaagggcatacttgtcaatcggtcatcaaccggacaagacaaatgcgagctctaatcgactcaaagaagccttaccaagcacactctgtattcaagcacttaatggatgaggggcacaagccttcattggtcacatacacaattctactgaccgccctgacgaaccagaggatgtttgagtcgattccatcactgcttgctgaagttgaactagctggagttaggccagactccatcttcttcaatgccttgataaatgcgtttgttgaggcgaagcggatgggcgaagcgataaacacattctggaaaatgaaacattctggctgccacccaactacaagcaccttcaacacactgataaaaggttatggcattgtaggcaaacccgaagaatcacagcgcgtcttcgacatgatgggcgttgaaggatcagtcaggcctaacctcacaacatacaacattcttgtgaaggcatggtgtgatcacagaaatcttgaggaggcctggggtgttgtgggcaaaatgcaagcaggtggttttgagcctgatattgtaacttacaataccatagccagtggcatatgccaataatgacgagacatggagagcagaagagctcattgtggagattcagactagagtgcgcaccagtgagcgaacatggggcataatcattggtggttattgccgggagggcaggttggaggaagcattacgatgcgtccagcaaatgaaggatgcaggaagtgttcctaacgtcgtcatcttcaacacactgctgaagggctttcttgatgcaaatgacatggctgctgtcaataagatcctgggtctgatggagaaatttggcatcaaacctgacatcgttacctacagtcaccagttgaacacattcagctcgctgggccacatggctaaatgcatgcatgtatttgacaaaatgatcgaagcaggaattgagccagatcctcaggtatacagcattctcgccaaaggatttgttcgtgctcagcagcctgagaaagcagaagaccttctgttgcaaatgagccatcttggtctctgcccaaatgtcgtcactttcaccactgtcattagcgggtggtgcagcgtggccgacatggagagtgccatgagagtctatgacaagatgtgcaagtcaggcgtctatcccaatctcaggacatttgagactctgatctggggctacagcgaacagaagcagccatggaaagctgaggaagtccttcagatgatgcgggagactggtgtcaagccgaagcaaagcacctactgtctcattgctgatgcatggaaggctgttggtttgactgagaacatcaacaactcaaatggttcccccaatggtccttatgcaatcgagaaattggatcattcaaatgacaattgcaacgtgcgaatatcagaagacaataataacaagctgcagttttttgatgaaagtaatgggcgtgcaatgaatggccgttcacgttccagttttcttcagataacaaatgcactaggcagcagtggtatagtttctgccaaggtcatgaaggctggagaatttccatctgaaagactgaaggctatcaaaaacacatcctttccacaaggatttcaattgttgcatctcgagttttgtaggaagcagcttcggaagaatggtggattctgtagtcagagcatcaactcattcaaaatgggtttctctagcagaggatgcatttattaattcgatgtacacattgggctgaaacttaaacaaaaacaaatctcggtgttccaagtctccgcctatgatgcgggccatttttatgattcagacgcagttcctgc

SEQ ID NO: 875 - DNA, 1901 bp, Zea mays
caaaaaagcaggctggtaccggtccggaattcccgggatcagaacttggacagcatcacgtcgctggatcagagtgccatttctgttctcagaaggtttctttgtgcctcagacgacccatcatcctccgcataactccatcgacgtcgatggcctgcatgtacatcaacggtcactgccttgtccagtaagtaacacgtacgagacgccgccatggcgggcaacaagttctcgtcgtaccacctcgccgcggccctccgccgcgagccggaccccgccgccgcgctccgcctcttcctcaaccctcccgcatccgccaccccgttccgctattccctccgctgctacgacctcatcatctccaggctcgccgccgcgcgcctcttcccggccatggagtccatcctctcgcgcctggcctcctcctcgggtccccggccccgcgagcagctcctctgccgcgtcgtctccgcctacggccgcgcccgcctccccgccgccgcgcgccgcgccttcgcgcacccggccttccctgggccccgcaccgccagggctctcaacgccctcctccacgccctgctcgcctgccgcgctcccctccgcgacctcctcgccgtctgccgtgacgctgggaccccgccggacgcgtgcacctataacattctcatgcgggcagcggctgcgtccggctcccttgcccacgcgcgccacatgttcgacgaaatgctgcgacggggcatcgcgccgactgtagtcactttcggcaccctcgtcgccgcgctgtgcgctgctggccagctggaaggcgcgttcgaggtgaaggaagtgatggtccggcagtaccacgtgttgccgaacgtgtatgtgtatacaagtctgatcaaggggctctgtgagaaaggggatgtggatgctgcggtggcgctcaaggaagagatggcaggaaaggcagatcttgtgctggattctgctgtgtatgcgacgcttgtacgggcgttgttccaggtagggcgaaaaggtgcggtagttggattgctggaggagatgaaggggagtggggttgtggctgatacggtggtgtacaatgccatgctcgcaggcttttgtgaggatgagaaggatcttgctgctgcgttcgctgtgcttgacgatatgcagaagaatgggtgcaaggcggatgcggtgagctataatacattagttgcagggttgtgcaagctgggccggtggcgggatgcacatgaattggttgaggatatgccaaggcaggggtgccatccagatgtggtgacctacagaatgctctttgatgggatgtgtgctgctgaggagtttcttgaagcaaaccaggttttggatgagatggttttcaagggttttgcgccaagcaacgatggtgcacagaagtttgtccaggggattgagaaggaaggagatgtggtattgctagagtcagtgttgtgccgactagcgaaggtgaatgctttggtgccaagtggatgggaaaaagctgtaagtggtgcgctgaatgatcccacagagttgaggctagagaagcagcttgactctttaagaattgcttgattagacaccatagtggatttgatcaatacagtttgagtagcaaaaaaatggcaagcatgatttttaaagaaatcaatttgttcatctgttatacaaggctgccttgcaggagtcttacccaattcaggttagtttcttgcaggtagtattattaaagtcagagaaagattaaaatggaatctaaggtgtgcaacttattcaattgaagttaatttgccataagattggaatataagatggatctatggcaaaaaaagaatattcgtgtttgcaagtacatgatcgtatatattctagttttttggtatgcttctaaa

SEQ ID NO: 876 - DNA, 1479 bp, Zea mays
atggaacgctctgctgtgcttcccaatgccttcacctacgcagcgctcatcgccgcctgctccgcggaccactcgctgcacatcggacagcagctccatggccgcctcttcaagtctggtctggagcacgacacctctgcttgcaatgcgctcctcgacttgtacagcaagtcctccgcacgttccctcgacttgctgcttgctttccacgcggctgacatgcccaacgtggtgacctggacttccttcattgctggactgatgcgccatggcagggaacaagaggcgcttgcggcatttgctcgtatgcgggctaccggagtgaagcccaactccttcaccctgtccactcttctgaaaggctgcacctccgcacatgcatgtctgcacgctgcaaagatccatgcctatgtgctcaagaccagttcggagtcattggacgcggctgccggaaactcgtttgttgatgtgtacgcaaggtctgcaagaatggatgacgcgtggaaggtggctaccacaatgtccttcgtgagggacagattcacatacacaagcctggccaaagggctgaatcagatggggcttcaccacagggcactcggcatgatacttcacatgttccacgaggaggttagtatcgacggtttcagcctagcttgcttcctttctgctgctgcgacattggcatccatagagtccgggaagcagctgcactgctgtgcagtgaaattgggattgagcggtcaggtatctctctccaacagcctcataaacatgtacagcaggtgcaagagtctggaggatgctaagagtgttttccagtcaatcagggaacccagtgtcgtgtcgtggaatgctataatctttgggatggcattcaacggctcttacactgaagcgttgtcagtttttgaagacatgattctggctggagctcagcctgatggggtcactttcacagttgtgctttctgcctgcagccatggtggcttagttgacattggcatcaaacacttcaactctatggcgaatatgtttgatgtccccccacaaaagagccactatacattgttcctggatatgctaggacgatcaggccgctttacagaggtggcacacaccatcgaggccatgcccgtccagccagacttatcaatttacaggaccctgctggcatccgccgtgctcctcggatacaagatcatgacgaacagatatatttgtgggatgaagagggatgcaggcatccaagttctgtgctgccgatcaattgctgaaaaccgagcttgggttcttgttaagtattcccatggaaatttctggcatggcattctatcatcttttaatctaggatatcttattcctagtcctgtggaggcctcctttgcagagtggtggggaggagtgatcaatcagatccataaagacaagaagaagggcttcaacattgctatcatccttggggcattgtgcctttga

SEQ ID NO: 877 - DNA, 2260 bp, Zea mays
atggaggctgcagttgaagaagctgcactttctagttctaagagaactaaatggcagttcatgggagctagagatgcagggtctagagatgagctacgtcttgtctatggtgtttctgagcgtacagaaagcgatggtgcagctaatttaattcagaagttgagagctataaactatgctctgggtgaactaggacagtggtgtgcttacaaggttgcactgtcattcttgacagcactacagaatgatgaaagggccaactatcagttgactgaaggggctgcaatgaaaagtgacagtaatgatgttgaaatgcataattctgaaaaccccaagccaaatgaacttgaggagggagagctacctgacagtcatggtgaacatgtagatgaagtcattggtgccgcagtggccgatggaaaagttaccccaagggtgcaagctttgataaaaatacttctcaagtatcagcacactgaggattttcgtgctatcatatttgtagagcgagtggttacagcattagtcctccctaaggtctttgcagaacttccatcgttgggctttatacggtgtgcaagcttgataggtcataacaataaccaggagatgcggtcgtgccaaatgcaggatacaatcacaaaatttcgtgatggccgtgttacactgttagttgcaactagtgttgcagaggaaggacttgatattaggcagtgcaatgttgtcattcgctttgaccttgcaaagactgttttggcctacattcagtctcggggtcgtgctagaaagcctggatctgactacatattgatgcttgaaagaggaaatatgtctcatgaagctttcttgagaaatgctcggaatagtgaagagacattgagaaaagaagctattgagagaactgatctcagtcatctcgatggcacttctatgctaagccctgttgatatatcacctgattctatgtatcaggttgaatcaacaggtgccgttgtcagtctgaactctgcagttggactcgtacatttttactgctcacagctgccgagtgacaggctcatcagtagtttcctcattccagatactctattcttcgaccggaatttattatgcaaaagcatgagaaaccagggggttcaacagaatattcttgcaaacttcaactcccttgtaatgccccattcgagaaacttgaaggctgtttgtttagctgcttgtaagaagctacatgagatgggtgccttcacagatatgcttttacctgacagaggaagtggggaaggagaaaagactgaacaaaatgatgaaggtgatccactgcctggaacagcacgccatagagagttctttcctgaaggggttgctgaaattctacatggagaatggattttatctggaagagatggttaccaaagttcacagtttattaagttatatttgtattctgtgaactgtgtaaacattgggacttcaaaggaccctttcgttacacaactttcaaattttgctcttatttttggcaatgagctggatgcagaggttttatcgacgacgatggatctctttgttgctaggacaataataacaaaggcatctctcgtattccgtggaccaattgaaattacagaaagtcagctgatcctgcttaagagctttcatgttaggctcatgagcattgtacttgatgttgatgttgatccctcaacaactccttgggatccagcaaaagcatacctctttgttcctgtgggagctgagaaatgtatggatcttttaagagagatagattggactctagttaatagcattgtgaattctgatgcctggaacaaccctcttcagagggcacgcccagatgtctatctaggcacgaacgaaaggacacttggaggggataggagggaatatgggttcgggaagttgcgccatggaactgcatttggacagaaagcccaccctacgtatggtatcagaggagccatcgctgaattcgatgttgtcaaagcgtctggattagttcctggtcgtggatggggacattttaatgattatcaaaataaaggcaagttgttcatggcagattcatgttgggatgccaaagatcttgctggaatggttgtaactgccgcccactcaggaaaaaggttctatgtggacagtatttgctataatatgaatgcagaaaattctttccctgaggaagagagggctatctgggtcccttggaatacagctcgtttgctgattactacaagcagaa

SEQ ID NO: 878 - DNA, 3460 bp, Zea mays
  misc_feature (859)..(859): n is a, c, g, or t
caaagttcacagtttattaagttatatttgtattctgtgaactgtgtaaacattgggacttcaaaggaccctttcgttacacaactttcaaatttcgctcttatttttggcaatgagctggatgcagaggttttatcgacgacgatggatctctttgttgctaggacaataataacaaaggcatctctcgtattccgtggaccaattgaaattacagaaagtcagctgatcctgcttaagagctttcatgttaggctcatgagcattgtacttgatgttgatgttgatccctcaacaactccttgggatccagcaaaagcatacctctttgttcctgtgggagctgagaaatgtatggatcttttaagagagatagattggactctagttaatagcattgtgaattctgatgcctggaacaaccctcttcagagggcacgcccagatgtctatctaggcacgaacgaaaggacacttggaggggataggagggaatatgggttcgggaagttgcgccatggaactgcatttggacagaaagcccaccctacgtatggtatcagaggagccatcgctgaattcgatgttgtcaaagcgtctggattagttcctggtcgtggatggggacattttaatgattatcaaaataaaggcaagttgttcatggcagattcatgttgggatgccaaagatcttgctggaatggttgtaactgccgcccactcaggaaaaaggttctatgtggacagtatttgctataatatgaatgcagaaaattctttccctaggaaagagggctatctgggtcccttggaatacagctcgtttgctgattactacaagcagaagtaagatcggnattaccggctcgaccccgcgtccgagaagcttcttcttgcaattcaactgaaggacataattgggtatccagttcctgcaaataagatattagaagccttgactgctgcgtcatgccaggagacattctgctatgaaagagcagagctgctggggatgcatacttgaaatgggttgtgagtagattccttttcctaaaatatcctcaaaagcatgagggacagctcacaaggatgcggcagcagatggttagcaacatgatcctgtatcaatacgccctgaataaaaacctccaatcttatatccaagcagatcgatttgctccatcaagatgggcagctccaggagtgttacctgtatttgatgaagaaacgagagattctgaaccatccatctttgatgaggaatttactcctagcagtgagttacaaaagaacttgtatgatgactatgatggcgatagcatgcaagaagacggtgaaattgagggagattctagctgctatcgtgttctatcaagcaaaacattagcagatgttgtggaagcacttattggtgtctattatgtagctggagggaaaattgctacaaaccatctgatgaaatggatcggtattaatgcagagttggatcctcaagagatcccatcttcgaagccatataacatacctgagagcataattaaaagcatcaattttgacacattagagggtgcattgggtatcaagtttcagaataaaggcttacttgttgaagctataacacatgcatcaagaccatcatcaggtgtttcctgttaccagcgcctggaatttgttggtgatgctgtattggaccatctcattacgaagcacttattttttacttatacggacctacctccaggccgcttgactgacttgagagctgcagctgttaataatgagaactttgcaagggttgcagttaaacataagctacatgtacatcttcgccatggatcatctgcattggagacacagattcgagagtttgtgaaggatgtccaggaggagctttcgaaaccaggtttcaattcttttggccttggggattgtaaggctccaaaggttctcggagacatttttgagtctattgctggcgcaatattccttgatagtgggtgtgctacctccgtagtctggaaggtttttcagcctctgcttgatccaatggtgacgccggacacccttccgatgcaccctgtaagggagctccaagagcgctgccagcagcaagccgaaggattagaatacaaagcatcccgtacaggcaatgtagctacagttgaagtcttggttgatggcatacagattggtgtagctcagaacccacagaagaagatggcacaaaagttggcggctagaaatgcacttgttgtcttgaaagagaaggaaaccgcagcaaagaaagacactgaaaaggatggcgagaagaaaaacggttctcagttcactaggcagactctgaacgacatctgcttgagaaggcaatggccgatgccacagtacaggtgtataaacgagggtggccctgcccatgccaaaagatttgtttatgcggtaagggtaaatacatctgacagtggatggactgacgagtgcattggagagccaatgccgagtgtgaaaaaggccaaggactctgcagctgttcttctgctcgagctgctgaatcgaaattaccgtggcaagcctgatggaaaataatctttggtgatgttctgtggtggtaggtagacgtggaagcatccatcattctgattatacccccatgcagtgcttttcagcaaagcaaattaatggcctttgttgatgttcttggtggcggtattggtgatatggaggcattcaatgcaagcataagcagagctatggggagtgggattagaggattattattagttttgtctgaggtgactactaggtattttactggcgaggtactgaggtcacaactcacaaatagcagttgcaaattgcaatagaggaaatgatgataggttgatataggatattggaggcctcttattcatcgattgtataagatgtttacagaacagtgcattgatccattaaatttatattgattgatatttttatagtggatgcgcctgcagctgggaactcggggttctctatcttggcctcgccgaccaaatatcacgtacgtcgacgtccgcgaacagtatatatatggtaggcttggcgggcgtgatccccttgcgcatggtacagagcaagacgctgagctggatattctgataatcccgtatactccaacagaaactacagaatggaatcaagttgtacctgcgtttctgctgctcaaaaattgcgagatggaccatggacgtgtgttgtttggcaacaacgacgcaaccagcacggacaagaaggggggacatgcagtctctcgaaacctgtcctatacaattagaaagaaaaaaaagagggaaaataaaaggaaaagaacgcgagggcagggccggccggtcggtcggtgcctgcgccgcacttttgtcatgtgcctagcacaatcgagggcctcacctgcccgcctacctaaaaaatattttttggac

SEQ ID NO: 879 - DNA, 419 bp, Zea mays
gggtgccttcacagatatgcttttacctgacagaggaagtggggaaggagaaaagactgaacaaaatgatgaaggtgatccactgcctggaacagcacgccatagagagttctttcctgaaggggttgctgaaattctacatggagaatggattttatctggaagagatggttaccaaagttcacagtttattaagttatatttgtattctgtgaactgtgtaaacattgggacttcaaaggaccctttcgttacacaactttcaaattttgctcttatttttggcaatgagctggatgcagaggttttatcgacgacgatggatctctttgttgctaggacaataataacaaaggcatctctcgtattccgtggaccaattgaaattacagaaagtcaggttaattttctttgcaatg

SEQ ID NO: 880 - DNA, 1274 bp, Zea mays
tttaggtgaactatagaacaagtttgtacaaaaaagcaggctggtaccggtccggaattcccgggatgcagcacatatcaattagtaactagctaggtagaagaagatgagctcgtcgatcagcatgatggaggcgagaatgcctccggggttcaggttccaccccagggatgacgagctcgtgatggactacctcctacaaaagctctccggccatggccaccatgccggcgctgccatcgtcgtcgacgtcgacctcaacaagtgcgagccatgggacctcccagattccgcgtgcgtgggtgggaaggagtggtacttcttcagcctgcgcgaccgcaagtacgcgacggggcagcgcactaaccgcgccacgcactccggctactggaaggccaccggcaaggaccgcgccgtcgtcgccggcggcgaggtggcggtggggatgcgcaagacgctggtcttctaccggggccgcgcgcccagggggaagaagacggagtgggtcatgcacgagttccgcctccacccccatgccgcgccgtgcctgctagcagcagctgcgccaaacaaggaggactgggtgctatgcagggtgttctacaagagcagaacaaccagcccaaggccagaatctgaagacgcccgggacggcaccccatcagctgaaccgcaactgccggctgccctgccgcttgcgcccctcgctgacacctacgccgccccaacggttgcagagcaggtgtactgcttctccggtctgccggcactgccattcagaagaccagtgagccttggggaccttctggagttcgacgcctccgagaaggaatctgtcacgacagcgatgaccagtgtctcgaacaacactagttcagtgctggagctggctccaaattgcaactggaaccaggaaaatggcatgtcacggatgtggagcccccttgggatatgagatagatctgtgttgtttgctggatctggatgtatggagtgttagtactgagtggccagtagggttctgctgcttagatttgattagcagtgtgacttgcagattgtgtagattagattatccgttattggactaatggcttggcgtagtatttgtacatattactactgaaggaacagtgtccttatccttgtttggcgtagtatttgtacatagcacctgctaaacttcagacaatcagtgaaagacaaatgtgtacattgtaaaaaaaaaaaaaaaaaaaaaaaaaaaaaaaaaaaaaaaaaaaaaaaaaaaaaag

SEQ ID NO: 881 - DNA, 1581 bp, Zea mays
atgaataaaattctattcttgttttttgtcatcacgtacgcactgtatttttttccttctgatttctccatagtacacaaataatgtatttacacatctgtcgtcattaattgatggcatagggcatacagacatatatatatctctcttttcatttctccttctttttgaaggatgtgtactgagatggtactgctactatatgtatatatatacctactactactacggctacatgcaataccacacaggaggcacacacacccaagcctcttgtagcactcatctatatatccatcctgttatcgtcgaggcatttcgatccgcatcgctctccataacaataatatatatataatcttcctataaaacataatcaactaattgaacgaattccacatctgcgtgaagccactctcagctaagtactcaaacccatcctgagaaaaattgcttggaggcgcctccctcttgacgctgccttcgaacctgctaaactggctcatgagaacatccttgattattgacttccccatctgctgctccggatcagccatggcggcagacggcggcagccgggcggcgttcatcgacgacgatggctgctgagaggggttactggagaagcagggcacttgctcataaccctctaggttctgcactgatgatgagccaggctggtcaaaggagatattgaagttgttgtcaataaggggaggcaatgaagttgtggctgcatcaatattgaagctgctgctctctgtgggcggctttgcaactgttgccctactcttgtagaaaactctacacaagacccagtcctccttgaaaggtaatttcatgggatcatctcgcccttccatgcgaaactcatgcataacccactcggtcttctttccctttggggctctaccttgataaaacacaagggttttgcgcataccaacaagtaaccctttccggcttattggacggtctttccctgtggccttccagtatcccgaatcagttgctctgtttgtacgctggccagtggcatactttctatctctaaggctgtagaaataccactcttttccaccaatgcacgcgatgtcgggaaggtcccagggctcgcacttgttgagatcgacgtcgaccatggtggggcagccgtagatgctcaccaccacagggcctccgccgccgccgagcttcttggccaggtagtccagcacgagctcgtcgtcgcgcgggtggaacctgaaccccggaggcaggctggcctccaccatgctcagcgacttgatggccatcatcggcgtcgtcgcggagctatatatatatatatacagctctcaagaacgacctcgctcaccggcgcgcggcagctacgtacaggtgtggagctgcttctactcctcctcctccttctcctacccctgtatcatagaagagaaattaagaagaagctggagagcggcgagaggcgggcgttatataacaggaggagcccgcgctgccgctgctgtacgtggtcaacttctgcgatcccgggaattccggaccggtaccagcctgcttttttgtacaaacttgttc

SEQ ID NO: 882 - DNA, 867 bp, Zea mays
atggtcgacgtcgacctcaacaaggtcgagccatgggacctccccgtggcggcgtcggtggggccgcgggagtggtacttcttcagcctcaaggaccgcaagtacgcgacggggcagcggacgaaccgggccacggtgtccgggtactggaaggcgacggggaaggaccgacccgtggtggcggcgcggcgaggcgcgctggtggggatgcgcaagacgctcgtgttctaccaggggagggcgcccaagggcaggaagacggagtgggtgatgcacgagtacaggatggagccagctgctcctcttcttgatcaccaaccctcctcatccaactccaaggatgaagattgggtgctgtgcagagtcatctgcaagaagaaactggcagcaggaggccgcgcaggagggggaagctcaaggagcctggtcgccagcaacggcggccgcgagaccgcgccagccaccccgccgccgccgccgctgccacctcgcatggacacggacgccaccctagcacagctccaggccgccatgcacgccaccgccggcgcgctcgagcaggtgccctgcttctccagcttcaataacaacactactgccagctctagagctgctgccgcagcagcagcagcagcgcagccatgctacctgcccagcatggccacaggcggcagccacggcacgacgagctactacctggaccacgcgatgctgccgcctgagctaggtggctgcttcgatcctctccacggcgacaagagctgctcaaggcggtgctgggccagctcggcggcgacgcggtggcgccgggcctgcacctgcagcacgagatggccgccggcgctgtcgtcgcttcgtccgcttgga

SEQ ID NO: 883 - DNA, 1598 bp, Zea mays
ggagaggtgttccttggcgccacgtctctttctgctaaaaggacgccgtgccgttccagtatttaaacggggaactcgaacccgggcgggggtttctcttgatcgcttcgtcacttgaatccgtgcctgctctaatagaggctctgcaatggagcaggagccgcaccggcccatggagctgcccccgggcttccgcttccacccgaccgacgaggagctcatcacgcactacctggcccgcaaggccgccgacgcccgcttcgccgcgctcgccgtcgccgaggccgacctcaacaagtgcgagccctgggacctgccatcgctggcgaggatgggggagaaggagtggtacttcttctgcctcaaggaccgcaagtacccgacggggctgaggaccaaccgggccacggaggccgggtactggaaggccacgggcaaggacagggacgtcttcaggggcaaggcgctcgtcggctccaagaagacgctcgtcttctacacggggagggcgcccaggggagagaagtccggatgggtcatgcacgagtaccgcctccacgccaagctccacggccacggccacggccacggccaaggcgcagccgtcgtcgtcgtccccaaggccgccgggaccaagaacgagtgggtgctgtgcagggtgttcaagaagagcctcgtcgtaggtggtgcagctgcagcagcagcaccaaccgcaggcaagaggggcggcacggagacgtcgtccaactccaagacggacgacgtagcggccatctcccacctccctccgctgatggacgtgtccggctccggctccggcgccgccgccgcggcggcggcacacgtgacctgcttctccgacgcgctggagggccagttcttggaccagacgacgaccacgccgccgccagaagccgccgccgccgccacggacgacgacggccacctcggcgccctcgccgccgcctcctcttcggccttccagctgcccggcttcgcgcactactattacggcgggggggcgccgcacctgcaccagcaccacggcgccgccagcctggtgcagctcctggagggcagcgttccgccgtgcaataagggcggcgagcgggagcgggagcgggagcggctgagcgcgtcgcaggacacggggctcacctccgacgtcaaccccgagatctcctcctcctccggccaacgcttggaccacgaccacgaccaccacctctgctgctggggctactgatcgattcgatgagcctacgactaccgatccagcgcgcatcatgcatgcggtcgcgttattactagcgattagtgtatagcactgctgtaaataaaacacctactagtactacatttgcgtgaggtcgacgatcggccgtgtggtgcgtggcaattggcatgcatgcgtcgagctgcctacgttccattatttgctcgtgtgatttgttactgtagacgagtgtgggggtgtgtaattagcattgttgatgtattattattcacgatttggtggaatatctccatggttaaatgacgccgccaaagcatgcatgatatcattacctaaaagtttgacctgtaatgatatgatc

SEQ ID NO: 884 - DNA, 1690 bp, Zea mays
  misc_feature (1676)..(1676): n is a, c, g, or t
ggctcgagcaccctcgcattggtttctcttgatcgctttgtcacttgaatccgtgcctgctctaacagagagcggagacgaccacgacgacggcgaggccaggctctgcgatggagcaggagccgcaccggcccatggagctgcccccgggcttccgcttccacccgaccgacgaggagctcatcacgcactacctggcccgcaaggccgccgacgcccgcttcgccgcgcttgccgtcgccgaggccgacctcaacaagtgcgagccctgggacctgccatgtaagcaacgcacgcgccggcatagctactagatcatgtttctgcacggatcgagtcatgcatggcttcataaaggaagaagaagaagggagttatgatatgtgatttggttgcgccagcgctggcgaggatgggggagaaggagtggtacttcttctgcctcaaggaccgcaagtacccgacggggctgaggaccaaccgggccacggaggccgggtactggaaggccacgggcaaggacagggacgtcttcaggggcaaggcgctcgtcggttccaagaagacgctcgtcttctacacggggagggcgcccaggggcgagaagtccggatgggtcatgcacgagtaccgcctccacgccaagctccacggccacggccacggccacggccaaggcgcagccgtcgtcgtcgtccccaaggccgccgggtccaagaacgagtgggtgctgtgcagggtgttcaagaagagcctggtcgtaggtggtgcagctgcagcagcagcaccaaccgcaggcaagaggggcggcacggagacgtcgtccaactacaagacgggcgacgtagaggccatcgcccacctccctccgctgatggacgtgtccggctccggctccggcgccggcgccgccgccgcggcggcggcacacgtgacctgcttctccgacgcgctggagggccagttcttggaccagacgacgaccacgccgccgccagaagccgccaccgccgccacggacgacgacggccacctcgggcgccctcggcgcctcctcctcgcccttccagctgcccggcttcgcgcactactactacggcggcgggccgccgcacctgcaccagcaccacggcgccgccagcctggtgcagctcctggagggcagcgtgccgccgtgcaataagggcggcgagcgggagcgggagcggctgagcgcgtcgcaggacacggggctcacctccgacgtcaaccccgagatctcctcctcctccggccaacgcttcgaccacgaccacgaccatgaccaccacctctgctgctggggctactgatcgtcgattcgatgagcctacgacgactaccgagcgcgcatcatgcatgcgtcgcgttattactagcgattagtgtatagcacactgctgtaaataaaacatctactagtactacatctgcgtgaggtcgacgatcggccgtgtggtggtggtggtgcgtggcatgcatgcgtcgagctgcctacgtttcattatctgctcgtgtgatttgttactgtagacgagtgtgggggtgtgtaattagcattgttgatgtattattattcacgatttggtggaataatatctccttggttaatgacaccgccaaaaaaaaaaaaaaaaagcggccctcgagctgccagnttgttgttctcctt

SEQ ID NO: 885 - DNA, 1546 bp, Zea mays
tgacactatagaacaagtttgtacaaaaaagcaggctggtacaacaactccactcccgcggaaaaaaaacccatatccctccggcataaacccaaaaagctgcaagcagtgtgaccaaaagcaggcctgacggcgatcctcggctctctagccaggcagcaggagatggagcacgacgtgcaccaccagcaccagcaggccatggagctgccgccggggttccgattccaccccaccgacgaggagctcatcacgcactacctcgccaggaaggccgccgacgcccgcttcgccccgcgcgccgtcggcgaggccgacctcaacaagtgcgagccatgggacctgccatcccgggcgacgatgggcgagaaggagtggtacttcttctgcgtcaaggaccgcaagtacccgacggggctgaggacgaaccgggccaccgagtccggatactggaaggcgacgggcaaggacagggagatcttcaggagcaaggccctcgtcggcatgaagaagacgctcgtcttctacacggggagggcgcccaggggaggcaagaccggctgggtcatgcacgagtaccgcctccacggcaagcacgccagcagcagccgcctcatgccgtcgtcggtcagagctggcgcgtcaaaggacgagtgggtgctgtgcagggtgttcaagaagagcatcgagccgccgccgtcagtgggcaagaggtcgtcggtcgcgtgcacggggacgatggtggtggaggacgtcgtgggaccgccgtccatgtccatggaggacgacctcaccgcgtgcgcgctgcctccgctgatggacgtgtccggcggtggcggcgccaacatggcggcggcgtccatcgagctgctggcgccaccggcaccacacgtgacctgcttctccaacgcgccgtggagggccagttcctgaacccaccattcctcctcccttccgccgccgcagccgcggaccacatcgccctggcggcctccgcctcgccgttcctggcgagcatgatgatgcagcagcaggcgcagtacgccggcgacgggctcctgcagggggccggcgggtggtacggcaagctggccggcgagagggagcggctgagcggcggcgtccccgccgagatctcgtcgacgcggcactgcatggatcacgaggcctccttctggggcttctgagctgatctcgaccttttccgcgatcgttaaaaactggattagattagccaccggattggaaacgggggattctagtgtgcttttttttaaatgggagcaaaaattgttgtgaagaaagtttgttttgcgtagtactaaattaattgatttgggtttagagttatatatagcgtgcctgtgtgatacttgtgtgaagatctatgaggaacgcagaaatccttaggcaatctcaaatcatacatactaaaaactatagtgtgtgtctgtaaaagctagaaatggctacgtggagcgaggatattctgcaatggttctgcattatattatatatactacaattataatttgtgtcatgactt

SEQ ID NO: 886 - DNA, 1748 bp, Zea mays
gcggcgatccttggctcactatccaggcagcaggagatggagcacgacgtagactaccatgaccaccaccaccagcagcagcaggaggaggaggaggaaaaaatctcccccttaacaactccactcccgcggaaaaaaaacccatatccctccggcataaacccaaaaaggttagcagcctcctcctactcgatctcccagatccgcactatctctgatgctacctgcttctttattactagctgtatcgatcgatcgatccagcgttgtttagctgacgagtcctgtttaattctgcgtgtttagctgcaagcagtgtgaccaaaagcaggcctgacggcgatcctcggctctctagccaggcagcaggagatggagcacgacgtgcaccaccagcaccagcaggccatggagctgccgccggggttccgattccaccccaccgacgaggagctcatcacgcactacctcgccaggaaggccgccgacgcccgcttcgccccgcgcgccgtcggcgaggccgacctcaacaagtgcgagccatgggacctgccatcccgggcgacgatgggcgagaaggagtggtacttcttctgcgtcaaggaccgcaagtacccgacggggctgaggacgaaccgggccaccgagtccggatactggaaggcgacgggcaaggacagggagatcttcaggagcaaggccctcgtcggcatgaagaagacgctcgtcttctacacggggagggcgcccaggggaggcaagaccggctgggtcatgcacgagtaccgcctccacggcaagcacgccagcagcagccgcctcatgccgtcgtcggtcagagctggcgcgtcaaaggacgagtgggtgctgtgcagggtgttcaagaagagcatcgagccgccgccgtcagtgggcaagaggtcgtcggtcgcgtgcacggggacgatggtggtggaggacgtcgtgggaccgccgtccatgtccatggaggacgacctcgccgcgtgcgcgctgcctccgctgatggacgtgtccggcggtggcggcgccaacatggcggcggcgtccatcgagctgctggcgccaccggcaccacacgtgacctgcttctccaacgcgctggagggccagttcttcctgaacccaccctgcctccacccctccacgtcgccgctccgcctggcgagcatggtgcaggcgcaggcgcaggcgcagtacgacggcgacgcgggcatggtgctccagctcctgcaggaggccggcgggtggtacagcaagctgggcgagggggagcggctgagcggcggcgcgtcgcaggacaccggcgtcacctcggaggtgaacgtgaaccccgccgagatctcctcgacgcggcaccacataatggaccccgaggcggcctccttctggggcttctgaacttcccccacatcttttttttccgcgatcgctaaaaattggattagaattagtcactggattggaaactgggattgtaattgtgccgttgaatattgctatatgcaaaatggggcaaaaaaaacaaaaagttgtgaacgaagtgtgtgtgtatatataatatatatatgcgcgcgcgcctgtgtgcacggtactatatatcccgcgacaaaattgtatttatgatgatagaattgtgtttaaaaaaaagggtcctattttggatcggaaaaaaaaaaaaaaaaacgagcccttggggtacccaattccccctaaaggggagtcgtatt

SEQ ID NO: 887 - DNA, 1623 bp, Zea mays
tccggaattcccagggatgaagaatccgcccccatccataccaccaaaaaaacccaaaaagaggcagcaggagatggagcacgacgtcgactaccatcaccaccaccaccagcagcagcaggaggaggaggaggaggccatggagctgccgccggggttccgcttccaccccaccgacgaggagctcatcacgcactacctcgccaggaaggccgccgacccgcgcttcgccccgcgcgccgtcggcgaggccgacctcaacaagtgcgagccgtgggacctgccatgtaagctctatcctagctgtcgtccgtccctccaccgcaacatgcacatgagtgctggagtgctaccaaatttaatttaaggtcggggtcctcctccactaatgagtaatgactcacgtcgtcacacgtgctcgtcgccatatgcatgcatggtgtgggtgcgcgcgcagctcgggcgacgatgggcgacaaggagtggtacttcttctgcgtcaaggaccgcaagtacccgacggggctgaaggcgaaccgggccacggagtcgggctactggaaggcgacggggaaggacagggagatcttcaggggcaaggcactcgtcggcatgaagaagacgctcgtcttctacacggggagggccccgaggggaggcaagaccggctgggtcatgcacgagtaccgcctccaaggcaagcacgccgccgccgccagcagtagcagcctcgtccgtcccgtcgtcggtcagagctggcgcgtcgtcaaagcaggacgagtgggtgctgtgcagggtgttcaagaagagcatcgagccgccatccgtgcccggcagcaagaggtcatcgtcggttgcgtgcatggggacggagggcacgggagtgggagtggggccgtcgtccatgtccacagaggacgacttcgccgcgtgcgccgcgttgcctccgctgatggacgtgtccggcggcggcgccaacatgtcgctttcagcagcggcggcggcggcggcggcgtccatcgagctgacgccacctgcaggtgcagcaccggcaccacacgtgacctgcttctccaacgcgccgctggagggccagttcctgaacccaccattcctcctcccttccgccgccgcagccgcggaccacatcgccctggcggcctccgcctcgccgttcctggcgagcatgatgatgcagcagcaggcgcagtacgccggcgacgcgggcgtggtgcacggcgacgggctcctgcagggggccggcgggtggtacggcaagctggccggcgagagggagcggctgagcggcggcggcgtccccgccgagatctcgtcgacgcggcactgcatggatcacgaggcctccttctggggcttctgagctctcgaccttttccgcgatcgttaaaaactggattagattagccaccggattggaaacggggattctagtgtgcttttttttaatgggagcaaaaattgttgtgaagaaagtttgttttgcgtagtactaaattaattgatttgggtttagagttaaaaaaaaaaaaaaaaaaaaaaaaaaaagggcggccgctctagagtatccctcgaggggcccaagcttacgcgtacccagctttc

SEQ ID NO: 888 - DNA, 1603 bp, Zea mays
ttgggacccctcgaggccggccgggctgcacgagaccattggctagctcgtccccggccgggggtttctcttgatcgctttgtcacttgaatccgtgcctgctctaacagagagcggagacgaccacgacgacggcgaggccaggctctgcgatggagcaggagccgcaccggcccatggagctgcccccgggcttccgcttccacccgaccgacgaggagctcatcacgcactacctggcccgcaaggccgccgacgcccgcttcgccgcgcttgccgtcgccgaggccgacctcaacaagtgcgagccctgggacctgccatcgctggcgaggatgggggagaaggagtggtacttcttctgcctcaaggaccgcaagtacccgacggggctgaggaccaaccgggccacggaggccgggtactggaaggccacgggcaaggacagggacgtcttcaggggcaaggcgctcgtcggttccaagaagacgctcgtcttctacacggggagggcgcccaggggcgagaagtccggatgggtcatgcacgagtaccgcctccacgccaagctccacggccacggccacggccaaggcgcagcccgtcgtcgtcgtccccaaggccgccgggtccaagaacgagtgggtgctgtgcagggtgttcaagaagagcctggtcgtaggtggtgcagctgcagcagcagcaccaaccgcaggcaagaggggcggcacggagacgtcgtccaactacaagacgggcgacgtagaggccatcgcccacctccctccgctgatggacgtgtccggctccggctccggcgccggcgccgccgccgcggcggcggcacacgtgacctgcttctccgacgcgctggagggccagttcttggaccagacgacgaccacgccgccgccagaagccgccaccgccgccacggacgacgacggccacctcggcgccctcggcgcctcctcctcgcccttccagctgcccggcttcgcgcactactactacggcggcgggccgccgcacctgcaccagcaccacggcgccgccagcctggtgcagctcctggagggcagcgtgccgccgtgcaataagggcggcgagcgggagcgggagcggctgagcgcgtcgcaggacacggggctcacctccgacgtcaaccccgagatctcctcctcctccggccaacgcttcgaccacgaccacgaccatgaccaccacctctgctgctggggctactgatcgtcgattcgatgagcctacgacgactaccgagcgcgcatcatgcatgcgtcgcgttattactagcgattagtgtatagcacactgctgtaaataaaacatctactagtactacatctgcgtgaggtcgacgatcggccgtgtggtggtggtggtgcgtggcatgcatgcgtcgagctgcctacgtttcattatctgctcgtgtgatttgttactgtagacgagtgtgggggtgtgtaattagcattgttgatgtattattattcacgatttggtggaataatatctccttggttaatgacgccgccaaaaaaaaaaaaaaaaccgggcccaagcatgcatgatatcattacct

SEQ ID NO: 889 - DNA, 1660 bp, Zea mays
tgaactatagaacgcgggcgggcaccggaatggcacaagcacacagctcatcagttcttcttcgtcgtcttggctagctgcctagctagctagctagttcctcactcctctccgagaaccccctttttcatctctctctctctctctctcggtctcgcccagctcctttcgatgttatcgtctctgctggcctcgcaactcgtcgagagagactcgtgaaaaagaatccagatatagctagagagaccgagagggcagctagcttaattattagcatgtcgatgagcttcttgagcatggtggaggcggagctgccgccggggttccggttccacccgagggacgacgagctcatctgcgactacctcgcgcccaagctcggcgccaagcccggcttctccggctgccgcccgcccatggtcgacgtcgacctcaacaaggtcgagccatgggacctccccgtggcggcgtcggtggggccgcgggagtggtacttcttcagcctcaaggaccgcaagtacgcgacggggcagcggacgaaccgggccacggtgtccgggtactggaaggcgacggggaaggaccgaccagtggtggcggcgcggcgaggcgcgctggtggggatgcgcaagacgctcgtgttctaccaggggagggcgcccaagggcaggaagacggagtgggtgatgcacgagtacaggatggagccagctgctcctcttcttgatcaccaaccctcctcatccaactccaagcaggatgaagattgggtgctgtgcagagtcatctgcaagaagaaactggcagcaggaggccgcgcaggagggggcagctcgaggagcctggtcgccagcaacggcggccgcgagaccgcgccagccaccccgccgccgccgccgctgccacctcgcatggacacggacgccaccctagcacagctccaggccgccatgcacgccaccgccggcgcgctcgaacaggtgccctgcttctccagcttcaacaacaacactactgccagctctagagctgctgccgcagcagcagcagcagcagcgcagccatgctacctgcccagcatggccacaggcggcagccacggcacgacgtgctactacctggaccacgcgatgctgccgcctgagctgggtggctgcttcgatcctctccacggcgacaagaagctgctcaaggcggtgctgggccagctcggcggcgacgcggtggcgccgggcctgagcctgcagcacgagatggccgccggcgctgtcgtcgcttcatccgcttggatgaatcacttctaggggacattagttcagcagcgaacctaagtatgtgattggttgcgtatattatgggaaatacatacatacatgtatacataattgtgtggtgaaacatttgtgtgtgaggcaaggagtagagcatgcgtcattttttttgttgctgccgatcgatttggacgagaaggccatgaggcaaggagtagaactctgtaatataatgatggctgctcaagtgtgtgtacacattcagatgcagaggtcgtatgtcatgagcgatgatcaggagaatttcatattggttaaaaaaaaaaaaaaaaaaaaaaaaaaaaaaaaaaaaaaaaaaaaaaaaaaaaaaaataaaaaaaaaaaaaaaa

SEQ ID NO: 890 - DNA, 1504 bp, Zea mays
  misc_feature (1389)..(1389): n is a, c, g, or t
  misc_feature (1393)..(1393): n is a, c, g, or t
  misc_feature (1422)..(1422): n is a, c, g, or t
  misc_feature (1468)..(1468): n is a, c, g, or t
  misc_feature (1488)..(1488): n is a, c, g, or t
ttgggtacctcgaggccggccgggatctgtctatctatctactggtctagtgtattgattactctacttgtcggctgtggcgcacagagagcggagacgaccacgacgacggcgaggccaggctctgcgatggagcaggagccgcaccggcccatggagctgcccccgggcttccgcttccacccgaccgacgaggagctcatcacgcactacctggcccgcaaggccgccgacgcccgcttcgccgcgcttgccgtcgccgaggccgacctcaacaagtgcgagccctgggacctgccatcgctggcgaggatgggggagaaggagtggtacttcttctgcctcaaggaccgcaagtacccgacggggctgaggaccaaccgggccacggaggccgggtactggaaggccacgggcaaggacagggacgtcttcaggggcaaggcgctcgtcggttccaagaagacgctcgtcttctacacggggagggcgcccaggggcgagaagtccggatgggtcatgcacgagtaccgcctccacgccaagctccacggccacggccacggccaaggcgcagccgtcgtcgtcgtccccaaggccgccgggtccaagaacgagtgggtgctgtgcagggtgttcaagcccggtcgtaattcccgcagctgcagcagcagcgcacgtttacgtcgtccaactccaaaacgggcgacgtagcggccatcgcccacctccctccgctgatggacgtgtccggctccggctccggcgcttccgccgcggcggcggcacacgtgacctgcttctccgacgcgctggagggccagttcttggaccagacgacgaccacgccgccgccagaagccgccgccgccgccacggacgacgacggccacctcggcgccctcgccgccgcctcctcctcgcccttccagctgcccggcttcgcgcactactactacggcggcgggccgccgcagcaccagcaccagcaccacggcgccgccagcctggtgcagctcctggagggcagcgtgccgccgtgcaataagggcggcgagcgcgagcgggagcggctgagcgcgtcgcaggacacggggctcacctccgacgtcaaccccgagatctcctcctcctccggccaacgcttcgaccacgaccacgaccaccatctctgctgctggggctactgatcgattcgatgagcctacaactaccgagcgcgcatcatgcatgcggtcgcgttattactagcgattagtgtacagcactgctgtaaataaaacatctactagtactacatctgcgtgaggtcgacgatcggccgtgtggtgcgtggcaattggcatgcatgcgtcgagctgcctacgttccattatttgctcgtgtganttgntactgtagactgcttgctgttgctattanacgagctagtgtggggttttgtattagcattggtgatgtattattncacgattgggtggatatctncctgggttatgacgcc

SEQ ID NO: 891 - DNA, 1675 bp, Zea mays
  misc_feature (1661)..(1661): n is a, c, g, or t
ggctcgagcaccctcgcattggtttctcttgatcgctttgtcacttgaatccgtgcctgctctaacagagagcggagacgaccacgacgacggcgaggccaggctctgcgatggagcaggagccgcaccggcccatggagctgcccccgggcttccgcttccacccgaccgacgaggagctcatcacgcactacctggcccgcaaggccgccgacgcccgcttcgccgcgcttgccgtcgccgaggccgacctcaacaagtgcgagccctgggacctgccatgtaagcaacgcacgcgccggcatagctactagatcatgtttctgcacggatcgagtcatgcatggcttcataaaggaagaagaagaagggagttatgatatgtgatttggttgcgccagcgctggcgaggatgggggagaaggagtggtacttcttctccctcaaggaccgcgggtacccgacggggctgaggaccaaccgggccacggaggccgggtactggaaggccacgggcaaggacagggacgtcttcaggggcaaggcgctcgtcggctccaagaagacgctcgtcttctacacggggagggcgcccaggggcgagaagtccggatgggtcatgcacgagtaccgcctccacgccaagctccacggccacggccacggccacaaggcgcagccgtcgtcgtcgtccccaaggccgccgggtccaagaacgagtgggtgctgtgcagggtgttcaagaagagcctcgtcgtaggtggtgcagctgcagcagcagcaccaaccgcaggcaagaggggcggcacggagacgtcgtccaactacaagacgggcgacgtagcggccatcgcccacctccctccgctgatggacgtgtccggctccggctccggcgccgccgccgcggcggcggcacacgtgacctgcttctccgacgcgctggagggccagttcttggaccagacgacgaccacgccgccgccagaagccgccgccgccgccacggacgacgacggccacctcggcgccctcgccgccgcctcctcctcggccttccagctgcccggcttcgcgcactactactacggcgggggggcgccgcacctgcaccagcaccacggcgccgccagcctggtgcagctcctggagggcagcgttccgccgtgcaataagggcggcgagcgggagcgggagcgggagcggctgagcgcgtcgcaggacacggggctcacctccgacgtcaaccccgagatctcctcctcctccggccaacgcttcgaccacgaccacgaccaccacctctgctgctggggctactgatcgattcgatgagcctacgactaccgatccagcgcgcatcatgcatgcggtcgcgttattactagcgattagtgtatagcactgctgtaaataaaacacctactagtactacatctgcgtgaggtcgacgatcggccgtgtggtgcgtggcaattggcatgcatgcgtcgagctgcctacgttccattatttgctcgtgtgatttgttactgtagacgagtgtgggggtgtgtaattagcattgttgatgtattattattcacgatttggtggaatatctccatggttaaatgacgccgccaaaaaaaaaaaaaaaaagcggccctcgagctgccagnttgttgttctcctt

SEQ ID NO: 892 - DNA, 1392 bp, Zea mays
  misc_feature (868)..(868): n is a, c, g, or t
cttaacaactccactcccgcggaaaaaaaacccatatccctccggcataaacccaaaaagccaggcagcaggagatggagcacgacgtgcaccaccagcaccagcaggccatggagctgccgccggggttccgattccaccccaccgacgaggagctcatcacgcactacctcgccaggaaggccgccgacgcccgcttcgccccgcgcgccgtcggcgaggccgacctcaacaagtgcgagccatgggacctgccatcccgggcgacgatgggcgagaaggagtggtacttcttctgcgtcaaggaccgcaagtacccgacggggctgaggacgaaccgggccaccgagtccggatactggaaggcgacgggcaaggacagggagatcttcaggagcaaggccctcgtcggcatgaagaagacgctcgtcttctacacggggagggcgcccaggggaggcaagaccggctgggtcatgcacgagtaccgcctccacggcaagcacgccagcagcagccgcctcatgccgtcgtcggtcagagctggcgcgtcaaaggacgagtgggtgctgtgcagggtgttcaagaagagcatcgagccgccgccgtcagtgggcaagaggtcgtcggtcgcgtgcacggggacgatggtggtggaggacgtcgtgggaccgccgtccatgtccatggaggacgacctcaccgcgtgcgcgctgcctccgctgatggacgtgtccggcggtggcggcgccaacatggcggcggcgtccatcgagctgctggcgccaccggcaccacacgtgacctgcttctccaacgcgctggagggccagttcttcctgaacccaccctgcctccacccctccangtcgccgctccgcctggcgagcatggtgcaggcgcaggcgcaggcgcagtacgacggcgacgcgggcatggtgctccagctcctgcaggaggccggcgggtggtacagcaagctgggcgagggggagcggctgagcggcggcgcgtcgcaggacaccggcgtcacctcggaggtgaacgtgaaccccgccgagatctcctcgacgcggcaccacataatggaccccgaggcggcctccttctggggcttctgaacttccccccacattttttttttccgcgatcgctaaaaattggattagaattagtcactggattggaaactgggattgtaattgtgccgttgaatattactatatgcaaaatggggcaaaaaaaaaacaaaaagttgtgaacgaagtgtgtgtatatatatatatgcgcgcgcgcctgtgttcacggtactatcccgcgacaaaattgtatttatgatgatagaattgtgtttaaaaaaaaaaaaaaaagggcggccgccaccgcggtgga

SEQ ID NO: 893 - DNA, 1044 bp, Zea mays
atggagcaggagccgcaccggcccatggagctgcccccgggcttccgcttccacccgaccgacgaggagctcatcacgcactacctggcccgcaaggccgccgacgcccgcttcgccgcgctcgccgtcgccgaggccgacctcaacaagtgcgagccctgggacctgccatgtaagcacgcacgcgccggcatagctactagatcatgttctaaaaggaagggagccacgggcaaggacagggacgtcttcaggggcaaggcgctcgtcggctccaagaagacgctcgtcttctacacggggagggcgcccaggggagagaagtccggatgggtcatgcacgagtaccgcctccacgccaagctccacggccacggccacggccacggccaaggcgcagccgtcgtcgtcgtccccaaggccgccgggaccaagaacgagtgggtgctgtgcagggtgttcaagaagagcctcgtcgtaggtggtgcagctgcagcagcagcaccaaccgcaggcaagaggggcggcacggagacgtcgtccaactccaagacgggcgacgtagcggccatctcccacctccctccgctgatggacgtgtccggctccggctccggcgccgccgccgcggcggcggcacacgtgacctgcttctccgacgcgctggagggccagttcttggaccagacgacgaccacgccgccgccagaagccgccgccgccgccacggacgacgacggccacctcggcgccctcgccgccgcctcctcctcggccttccagctgcccggcttcgcgcactactactacggcgggggggcgccgcacctgcaccagcaccacggcgccgccagcctggtgcagctcctggagggcagcgttccgccgtgcaataagggcggcgagcgggagcgggagcgggagcggctgagcgcgtcgcaggacacggggctcacctccgacgtcaaccccgagatctcctcctcctccggccaacgcttcgaccacgaccacgaccaccacctctgctgctggggctactga

SEQ ID NO: 894 - DNA, 1505 bp, Zea mays
gaaaaatggcacaagcacacagctcatcagttcttcttcgtcgtcttggctagctgcctagctagctagctagttcctcactcctctccgagaaccccctttttcatctctctctctcgcctagctcctttcgcgatgttatcttctctgctggcctcacaactcgagagagactcgtgaaaagaatccagatatataaagagatcgagggcagctagcttaattattagcatgtcgatgagcttcttgagcatggtggaggcggagctgccgccgggggttccggttccacccgagggacgacgagctcatctgcgactacctcgcgcccaagctcggcgccaagcccggcttctccggctgccgcccgcccatggtcgacgtcgacctcaacaaggtcgagccatgggacctccccgtggcggcgtcggtggggccgcgggagtggtacttcttcagcctcaaggaccgcaagtacgcgacggggcagcggacgaaccgggccacggtgtccgggtactggaaggcgacggggaaggaccgacccgtggtggcggcgcggcgaggcgcgctggtggggatgcgcaagacgctcgtgttctaccaggggagggcgcccaagggcaggaagacggagtgggtgatgcacgagtacaggatggagccagctgctcctcttcttgatcaccaaccctcctcatccaactccaaggatgaagattgggtgctgtgcagagtcatctgcaagaagaaactggcagcaggaggccgcgcaggagggggaagctcaaggagcctggtcgccagcaacggcggccgcgagaccgcgccagccaccccgccgccgccgccgctgccacctcgcatggacacggacgccaccctagcacagctccaggccgccatgcacgccaccgccggcgcgctcgagcaggtgccctgcttctccagcttcaataacaacactactgccagctctagagctgctgccgcagcagcagcagcagcgcagccatgctacctgcccagcatggccacaggcggcagccacggcacgacgagctactacctggaccacgcgatgctgccgcctgagctaggtggctgcttcgatcctctccacggcgacaagagctgctcaaggcggtgctgggccagctcggcggcgacgcggtggcgccgggcctgcacctgcagcacgagatggccgccggcgctgtcgtcgcttcgtccgcttggatgaatcacttctaggggacattagttcagcgaacctaagtatgtgattggttgcgtatattatgggaaatacatacatacatatatacataattgtgtggtgaaacatttgtgtgtgaggcaaggagtagagcatctgagcatgcgtcattttttctgttgctgccgatcgatttggacgagaaggccatgaggcaaggagtaaactctgtaatataatggctgctcaagtgtgtgtacattcagatgcaaaaaaaaaaaaaaaa

SEQ ID NO: 895 - DNA, 3130 bp, Zea mays
ccttccaacgccaaccaccccccaagaaaccggaaagcgaacggcatggcgaccccccgcagcgcagcacgccacgctccctcctctccctctcgcaggccatgacgcgccaccgtccttggcctccttcccatcctcctcctcctcatcctcttcctcttcgggtagtggcagcggcaccacaagcaaccggcagcggcgccgggaagaagatggcgaggctctccccgggggcggcggcgccgcaggtggacacgggcaagtacgtccgctacacgccggagcaggtggaggcgctggagcgcgtctacaacgagtgccccaagcccagctccctccgccgccagcagatcatccgggactgccccatcctctgcaacatcgagcccaagcagatcaaggtctggttccagaaccgaaggtgccgggagaagcagcgcaaggagtcctcccgcatgcagacggtgaaccggaagctgaccgcgatgaacaagctgctgatggaggagaatgaccggctgcagaagcaggtgtcgcgtctcgtctacgagaacgcgtcggtcaagagcctcaagactaagatccacaaggcttctgcggccaccacggacacgagctgcgagtctgtggtgacgagtggtcagcagcaagccctagcagccccgcgtccgcagagggatgcgaacaacccagctggtcttctcgcaatcggtgaggagaccttgacagcgttcctgtccaaggcgaccggaaccgctgtcgaatgggtgcaaatgatgggaatgaagccttgtccggattcattggaatcatcgctgtttcgcacaattgtattggcgtagcagcccgagcttgcggtcttgtgagccttgagcccacaaaggttgccgagatcctcaaggatcgtccatcttggtatcgcgactgtcgttgcgttgatatcctccatgttttccctacgggtaatggtggaactatcgagttaatctacatgcagacttatgcaccgacgactttggcggcaccacgcgacttctggacactccgctacacctgcggacttgatgatggcagccttgtgatctgtgaaaggtcattgactcagtccacgggtggtccatctgggcctaacactcctggttttatcagagccgaggtgctccctagtggttatctgattcgaccatgcgagggaggcggctccatgatccacattgtggatcatgttgatttggatgcttggagtgtgcctgaagtccttagaccgctctatgaatctccgaagatcgttgcacaggagatgactattgcggcactgcgacacatcaggcaaatcgcgcatgaatcaagtggtgaaatcccctatggtgctgggcgccagcctgcagttctcagaaccttcagtcaaaggctcagcagaggcttcaatgatgctgtgagtggctttccagatgatggctggtcttgtttgttgaacaccgatggtgctgaggatattacagttacaatcaactcatctccaaataaacttgttgggtctcatgtcagcgcttccccattattttctgctatggggggtggaatcatgtgcgcaaaagcatcgatgctgctgcagaatgtgccacctgctctacttgtgcgatttttgagggagcatcggtctgaatgggctgatcctggcatcgatgcttattctgtcgcctctttgagggccaacccatacactgttccaggtttaagggctggtgggtttatgggcaaccaggttatactgccccttgcacgcaccttggagcatgaagagtccttggaggttattaggcttgaaggacatggctttagccatgaggaggtgcttatgtcccgggatatgtttcttctacagctgtgcagtggcgtcgacgaggatgcacctggtgcgtgtgcacagcttgtctttgctcctattgatgaatcttttgccgacgatgcaccgttgctgccctcaggcttccgtgtgataccgcttgatgctaagacggatgtgccaacggccaccacacgcacgcttgaccttgcctctgcgctcgaggttggatcaggtggaagcggcatgcgcgcttcatgcgatggttccggcacgtgcgccacgagatcggtcctgaccatcgccttccagttctcgttcgagaaccaccttcgcgagagcgtggcggcaatggccaagcagtacgtcaggggcgtgatggcctccgtgcagagggtggccatggcgatcgctccttctcgcctcggttcgcgtatcgaactgaagcatccgccgggctctcccgaggcacttgcactagctacgtggattggcaggagctacagggcgcacactggaacggagatccgctggtcggacaccgaaggcgcggactctccactgatgctgttctggaagcacagcgacgcgatactctgctgctctctgaagccgccggctttcacgctcaagttcgccaacagcgccggcttcgacatcctggagacgacgatggtgaacatccaggacctgccgctggaggcggtcctcgacgaggagggccagaaggccctgtccgcgcagctccccgcgatcatgcagcagggcctggcgtacctccccggtggcgtgtgcaggtcgagcatggggcggcaggcgtcgtacgagcaggcagtggcgtggaaggtggtgggtgacgacggcgccccgcagtgcctggcgctcatgctcgccaactggaccttcatctgaggctcgcaacatcgctcggcagcgccagaccggatgccgccttttgccctactacgtatcattagttgcttttccgttgtgccgcctgtgttaagaatttgtgtactgtgtggatgatcgagaactgactctgtttgtgtgtgtgcgtgacaaacaactacaacagctgtatgcgtgcctggtcgtggtctcgtctccccggcttgtcgccggcgacattgatcactgttgcaggttgcagtattactatttgctagttctgctaaaaaaaaaaaaaaaaaaaaaaaaaaaaaaaaaaaaaaaaaaaaaaaaagggcggccgctctagagtatccctcgaggggcccagagcttacgcgtaccctagctttc

SEQ ID NO: 896 - DNA, 3858 bp, Zea mays
tgacactatagaacaagtttgtacaaaaaagcaggctggtaccggtccggaattcccgggatgccgctgctcctctcctctcctctcctcgctagctccccccaagcgagcacgccgcccaccacgatgccagcgcgcacgggagccggctgctccgcctccgcctcctctccgctcccgcaccactagcgcgggagcccgatggcgagcagcagggggaggctgaggctctccccgcgcgcggcggcgccgcagctggacgcgggcaagtacgtgcggtacacggcggagcaggtggatgcgctggagcttgcctacggcgagtgccccaagcccagctcgctgcgccggcagcagctcatccgggactgcgccgtcctcaccaacgtcgagcccaggcagatcaaggtctggttccagaaccgcagatgccgggagaagcagcggagggagtcctctcgtctgcagaccgtcaaccggaagctgggtgccatgaacaagctgttgatggaggagaacgaccggctgcagaagcaggtgtcccgtctcgtcttcgacaacgggtatatgaagaatcggctccacagtccttctgtagccaccaccgacacaagctgcgagtctgtggtgacaagtggtcagcacaagcagcagcaaaacccagcagttctgcatcctccacaaagggatgcgaacaacccagcaggtctactcgctattgctgaggagacattggcggagttcatgtccaaggcgaccggaactgctgtcaactgggtgcagatggttgggatgaagcctggtccggattccgttggaatcatcgctgtttcgcacaactgcagcggcgtagcagcacgagcttgcggccttgtgagcctcgagcccacaaaggttgccgagatccttaaggatcgcgcatcgtggtatcgcgattgtcggcgtgttgatatcctccatgttatccctacgggtaacggtggaacgattgagctgatctatatgcagacttatgcactgacaactctggcggaaccgcgcgacttttggacactacgatacactagtggtcttgacgatggcagtcttgtgatctgcgaaaggtcattgacccactccactggaggtccttctggacctaaaactccagattttataagagctgaggtgcttcctagtggttatctgattcgaccttgtgatgggggaggttccatgatttacattgtggatcatgttgatctgaatgcttgtagtgtccctgaggttcttcgaccgctctatgaatctcctaagatactggcacaaaagatgactgctgcggcgttgcgtcacattaggcaaattgcacacgaatcaagtggtgaaacgccctatggtgctgggcgacagccagctgttctcagaactttcagtcaaaggctcagcagaggcttcaatgatgctgtgagtggctttccagacgatggctggtcttctttgttgagcagtgatggtgctgaggatatttcaattacaatcaactcatctccaaacaaacttattgggtctgatgtcagcccttccccattcttttctgccatggggggcggcatcatgtgcgcaaaagcgtcaatgctactgcagaatgtgccacctgctctacttgtgcgatttttgagggagcatcgctctgaatgggctgaccctggtgttgatgcttattccgctgcctctctgagggccaacccatataatgttccgggtttaagggctggtgggtttatgggcaaccaggttatactaccccttgcacgcaccgtggagcatgaagagtgcttggaggttattcgacttcaaggacatggctttagccatgacgaggttcttatgtccccggatatgtttcttctgcagttgtgcagcggcatcgatgaggatgcgccgggtgcttgtgcacagcttgtcttcgctcctatcgatgaatcttttgctgacgatgcaccgttgctaccctctggcttccgtgtgataccgcttgatgctaagacggatgtgccatctgccacacgtacccttgaccttgcttctgcgctcgaggtcggatcaggcggaggtctgtgtgctttaagcgatagcgggtcaggcacgcgcagcacgaggtcggtcctgaccatcgccttccagttctcgttcgagaaccacctccgcgagagcgtggcagcgatggccaggcagtatgtcagggcagtgatggcgatcgtgcagagggtggccatggcgatttctccctctcgccttggcccgcatgtcgaactgaagcatccgccaggctctcccgaggcactcgcactagcttcgtggattggcaggagctacagggcgcacactggaacggagatccgctggtcggacactgaagacgcggcgggctctcccctgacgctgttctggaagcacagcgacgccataatctgctgctctctaaagccggctttcacactcaagttcgccaacagcgccggcttcgacatactggagacgacggtcgcgaacgtccaggacctgcagctggaggcggtccttgatgacgggggacagaaggccctggtcgcacagctccccaagatcatgctgcagggcctggcgtacctccccggcggcgtgtgcaggtcgagcatggggcggcaggcgtcgtacgagcaggcggtggcgtggaaggtggtgggcgacgacggcgcgccgcagtgcctggcgctcatgttcgtcaactggaccttcatctgatgctcctccgctcttgacgttcacagcctcgtgcctcgctcggcagcgctagatcggttgccgcctttatcctatcctatccgactacgtattactagttgctttccgttgcacctgtgtgctacaactgctcgagacaatgcccctgctgtctgtttatggcctaagtctactgtggtggatcgggagttggagaacaatgcccctgctgtctgtttatgtgtgagacttaaccctattactactgctgttatcatgttcgtcaactggaccttcgtgtgagtgaggaccggccccctagcagagccagccagtcgcgcgcgcccgcccgcctagcatttgcagctgttatttgttgaactctgtatccaagtactggtcgctcttgcctttgtccaggcaatcctgtgaaacgcacctgccccccagttcatccgtggaacaaacgccttttgtagttgcttgcttgctatgttatgatggatcctggtctgctgcatctcctaaaaattggcttggaacattgcgtgcgtccccttctgctgaattcgttgcttctcgcttgattaaggaaagcgcggtacatgatgtggccgacctcggacgcagacgtggggacgtggtgggaggatggcagccgctgcggtggttggactcgcaaccgaactgattttgttaggtcaggtcaggtgcgcgtggtcttctggcagaggccacctgagctggcgatggacgtgaaggaaggagaggtggcagaagctacggctgagggcacctgaggacggcgacgggccgcctaatccccccggacccgtcgtcgtcgctgcgtgcgctggcgacggtcgtggcgccaaactcgctgcgtttcggcaaaggattagcgcaaccgcggcgctgtcgaaggtgtacgtgagcgctggatgatctcagattctcagtgatgggactttgttagatcaatccaaggaatggacagggagcgtttgtggttggttttgttccagccatgacatggaattcgctacgtgtcgtggcgcaactgcaaggaccgtgtgtgtgtgatgtgcatcgaagcttcaaatataactgatg

SEQ ID NO: 897 - DNA, 3250 bp, Zea mays
gaggccggccgggctctcccatccccgtctcgccgctagctttccctttccccccgctgctcctcccctccgtcctcctcctcaccctccccgcgcgccgcgcggctcggcaggcagccaagcaagcaacagctgcacaaccccccagcaccgccgccactcctctctctctctcctctctctctctctctctctctctctcgcaccaccaccatggcgtcgggcggctgcgctctcgccccgaggctatgactcggcgccgcccgtggccgtggctctccgtattctccgtctccccgcgacgacgacaacccctcctcctccgactccgactcctccctgggcggcggtgctagccagatgtcgacggcgctggcggtggtcgggggcggcaaggaccggccgtcgcccggcggcggcggcggcgccgcaggtggacacgggcaagtacgtgcgctacacccccgagcaggtcgaggcgctcgagcgcgtctacagcgagtgccccaaacccagctcgctgcgcaggcagcagctcatcagggagtgccccatactcagcaacatcgagcccaagcagatcaaggtctggttccagaaccgcagatgccgcgagaagcagcggaaggaggcctcgcgcctgcagactgtgaaccggaagctgactgcgatgaacaagctgttgatggaggagaatgacaggctgcagaagcaggtctcccgactcgtgtacgagaatggatacatgcgacagcagcttcacaatccttctgctgcgactacagacacgagctgtgagtctgtggtcacaagtggtcagcaccaccaacagcaaaacacagcagctccgcgtcctcaacgggatgcaaacaacccagctggtctcctagctatcgctgaggagaccttggcagagttcttgtcaaaagcgacaggaactgctgtcgattgggtgcaaatggttgggatgaagcctggtccggattccattggaatcatcgctgtttcgcacaattgtagtggcgtagcagcccgagcttgcggcctagtgagccttgagcccacaaaggtcgcggagatcctcaaggatcgcccttcttggtaccgcgattgtcggtgtgtggatattctccatgttatccctacgggtaatggtggaactatcgagcttatctacatgcagacttacgcaccgacaactttggcggcaccgcgcgacttttggactctccgatacactagtggtcttgaggatggcagtcttgtgatctgtgagagatcactgacacaatcgactggaggcccatcaggacccaacactccaaattttgtaagagccgaagtgcttcctagtggctatctaattcgaccctgtgagggaggtggctccatgattcacattgtggatcatgttgatttagatgcttggagtgtgcctgaggtccttagaccactttatgaatccccaaagattcttgcacagaaaacaactattgctgcactgcgtcacattaggcaaattgcgcatgaatcgagtggggaaatgccctatggagggggccgacagccagcagttttgagaacatttagccagaggcttagcaggggtttcaatgatgctgtcaatgggtttccagatgacggttggtcactgatgagcagtgacggtgctgaggatgttactattgctatcaactcttctccaaacaaacttattggtcctcatgtcaactcttcccagctgtttactgcgatcggaggtggcatcctgtgtgctaaggcatcaatgctgcttcagaatgtgccacctgccctactagtacgatttctgagggagcatcgctccgaatgggctgatcctggtgttgatgcttattctgccgctgctctgagggctagtccatatgcagttcctggcttgcgtgctagtgggtttatgggcagccaggttattctgccgcttgcacataccttagagcatgaagagttcttggaggttattaggcttgagggacacagcctctgccatgacgaagttgttctgtcacgagatatgtatcttctgcagttgtgcagcggtgtggatgaaaatgcagctggtgcatgtgcacagcttgtgtttgcacccatcgatgaatcttttgccgacgatgcgccactgctaccctcaggcttccgtgtcattccactggatgcaaagacggatccaccatcaggcacacgcacacttgaccttgcatctaccctcgaggttggatctggtgggacaacgcgtgcttcgagtgacgcctccagcacctgcaacacaagatcagtgctgaccattgctttccagttctcatatgaaaatcacctacgagagagcgtcgcagccatggccaggcaatacgtcaggaccgtggtggcatcggtgcagagggtagccatggcaatagctccttcgcgcattggtggacagcttgaaatgaagcaaactccaggatctcctgaggcacacacgctggcaaggtggatcggcaggagctacaggttccacactggagccgaactcctccgcacggacacccaatgcacggatgcttccttgaaagcgctgtggcaacactcggactcgatcatgtgctgttccctgaaggctgctcccgtgttcacctttgccaaccaagccggcctggacatgctggagacgacgctgattgctctccaggacatctcccttgagaagatccttgacgacgatggcaggaaggcgctctgcaccgagtaccctaagattatgcaacagggcttcgcgtacctccccggtggcgtgtgtgtgtcgagcatggggcggccggtgtcgtacgagcaggcggtggcgtggaaggtcctgagcgacgacgacaccccgcactgccttgccttcatgttcgtgaactggtccttcgtgtgagaacccggtcccctagtagtcagtagagccaagtcgcctagcgtttgcggctctgttgtttgaactctgtaccccatgtaccgtcgattttgcctgtgtccaggcaacctatgaaacacacctttgtagttgttcatcatccccgtggaacaaacagctttgtactagttgttcgtcttcgcttgcttgctatcttatgatggatcctggtttgctacagctcctgaaaaattgattggaccaaaaaaaaaaaaaaaaagggcggccgctctagagtatccctcgaggggcccagagcttacgcgtacccaagctttc

SEQ ID NO: 898 - DNA, 765 bp, Zea mays
  misc_feature (731)..(731): n is a, c, g, or t
atggatctaattagatgccgcgagaagcagcggaaggaggcctcgcgcctgcagaccgtgaaccgaaagctgagtgcgatgaacaagctgttgatggaggagaatgaccggctgcagaagcaggtttcccgtctcgtcttggacaacgggtatatgaagaatcgactccacagtccttctgtagccaccaccgacacaagctgtgagtccgtggtgacaagtggtcagcacaaccaacaacccagcagttctgcatcctccacaaagggatgcgaacaacccagcagggtaagcctgaaacctggttacatttcaaaccttatccttgctgtaatgctaattttccttttgtccagtctactcgctattgctgaggagacattggcagagttcatgtccaaggcgactggaactgctgtcaactgggtgcaaatggttgggatggagcctggtccggattccgttggaatcatcgctgtttcgcacaactgcagcggcgtagcagcacgagcttgcggccttgttgctgagatccataaggatcgtgcatcgtggtttcgcgattgtcggcatgttgatgtcctccatgttatccctacgggtaacggtggaacgattgagctgatctatatacaggggtttggttttgttaccatgccttgtgtcaaggaggcatatcgctacatcaaatatctaaatcgttttgtgatgcaagatcaggtcataactgntgagaaggtcataggtctacgacttcgtgcttga

SEQ ID NO: 899 - DNA, 3381 bp, Zea mays
ttaaattgtaagagagatcaacgtctgtaaatctgcaattctatcggttctcacgtggctgtaggcaaatgcgtgcgtgcgtgtggtgtgttgttggcgctcactgctcacctccaaaaggccggcactgtgtggggtcgtgttgcgcgccatgcgcgaccatgctgctgccttctgccacgcggggcatgtggctgccatcgaaagcacagcgccaccaccaacgaccacacctctcaagccaaaaaaacaaacaaacaaacaaaatggacgtacccgtctctcgccgctgggtttccctttcccttgcgctcctcctccttcactcctcaccctccccgcaggccgcggctcggcaagcaagcaacaacccccgccactcccctccctcaccaccatggcgtcgggcggctgcgctctcgccccgaggccatgacttggcgccgcccgtggccgtggctctccgtcttctccctctccccgcgacgacaacccctcctcctccctgggcggcggcggcggctctagctagctagctagatggcgtcggcgatggtggtgttcgggggcggcaaggaccggccgtcgcctggcggcggtggggcgccgcaggtggacgcgggcaagtacgtgcgctacacccccgagcaggtcgaggcgctcgagcgggtctacggcgagtgccccaagcccagctcgctgcgcaggcagcagctcatcagggagtgccccatactcagcaacatcgagcccaagcagatcaaggtctggttccagaaccgcagatgccgcgagaagcagcggaaggaggcctcgcgcctgcagactgtgaaccggaagctgactgcaatgaacaagctgttgatggaggagaatgacaggctgcagaagcaggtctcccgactcgtctacgagaatgggtacatgcgacagcagctccataatccttctgctgcgactacagacacgagctgcgagtctgtggtcacaagtggtcagcaccaccaacagcaaaacccagcagctccgcgtcctcagcgggacgcgaataacccagctggtctactagctattgctgaggagaccttggcagagttcctgtcgaaagcaacaggaactgctgtcgattgggtgcaaatggttgggatgaagcctggtccggattccattggaatcatcgctgtttcgcacaactgcagtggcgtagcagcccgagcttgcggcctagtgagccttgagcccacaaatgtcgcggagatcctcaaggatcgcccttcttggtaccgcgactgccggtgcgtggatatcctccatgttatccctacgggtaatggaggaactatcgagcttatctacatgcagacttatgcaccgacaactttggcggcaccacgcgacttttggactctccgatatactagtggtcttgaggatgggagtcttgtgatctgtgagagatcattgacacaatcgactggaggtccagcaggacccaacactccaaattttgtcagagctgaggtgcttcctagtggctacttaattcgaccttgtgagggaggtggctccatgattcacattgtggatcatgttgatttagatgcttggagtgtgcctgaggtccttagaccactttatgaatctccaaagattcttgcacaaaaaacaactattgctgcactgcgtcacattaggcaaattgcacatgaatcaagtggggaaatgccctatggagggggacgccagccagcagttttaagaacatttagccagaggcttagcaggggtttcaatgatgctgtcaatgggtttccagatgatggttggtcactgatgagcagtgacggtgctgaggatgttactattgctatcaactcttctccaaacaaacttattggtcctcatgtcaactcctcccagctgtttactgcaattggaggaggtatcctgtgtgctaaggcatcaatgctgcttcagaatgtgccacctgccctactagtacggtttctgagggagcatcgctccgaatgggctgatcctggtgttgatgcttattccgctgctgctttgagggctagtccatatgcagttcctggtttgcgtgctagtgggtttacgggcagccaggttattctgccgcttgcacataccttagagcatgaggagttcttagaggttattaggcttgagggacacagcctctgccatgatgaagttgttctgtcacgagatatgtatcttctgcagctgtgcagtggcgtggatgaaaatgcagctggtgcatgtgcacagcttgtctttgcacccatcgatgaatcttttgctgacgatgcaccactgctgccctcaggcttccgtgtcattccactagatgcaaagacggatccaccgtcaggcacacgcacgcttgacctagcatctactctcgaggttggatctggtgggactactcgcacttcaagcgatgcctccagcacctgcaacacaagatcggtgctgaccatcgctttccagttctcatacgagaatcacctacgagaaagcgtcgcagcgatggccaggcaatatgtcaggactgtggtggcatcggtgcagagggtggccatggcaatagctccttcccgtcttggtggacagcttgagatgaagcaaactcctggttcccctgaggcgcacacgcttgcgaggtggatcggcaggagctacaggtttcacactggagcagaactgcttcgcacagacacccaatgcacggatgcttccttgaaagcactgtggcagcactcggactcgatcatgtgctgttccctgaaggctgctccggtgttcaccttcgccaaccaagccggcctcgacatgctcgagacgacgctgatcgctctccaggacatctccctcgagaagatccttgacgacgatggcaggaaggcgctctgcaccgagtaccctaagttgatgcagcagggtttcgcgtacctccccggcggtgtgtgcgtgtcgagcatggggcggccggtgtcgtacgagcaggccgtggcgtggaaggtcctgagcgacgacgacacgccgcactgcctcgccttcatgttcgtcaactggtccttcgtgtgagtgaggaccggccccctagcatttgcagctgttatttgttgaactctgtatccaagtactggtcgctcttgcctttgcccaggcaaccctgtgaaacgcacctgccccccagttcatcccgtggccgtggaacaaacaccttttgtagttgcttgcttgctatgttatgatggatcctggtctgctgcgtctcctaaaaaaaaaaaaaaaaaaaaaaaaagggcggccgctctagagtatccctcgaggggcccgaagcttacgcgtacc

SEQ ID NO: 900 - DNA, 962 bp, Zea mays
tgtacaaaaaagcacggccggtaccgctccgcatctccccggcactgcccactcccatcccacgcgagcacaaccaccacctactccctactccctacactactccccccgcaagcacgcccagcgccatggccatggcggcagcgcgcacgggggcctgctactccgcctccgcttcctctcctctcctgcactactagcgggtccgctggcgacgatggcggcggtggcgagcagggagaggctctccccgggcgccgcgccgcaggtggacgcgggcaagtacgtgcggtacacgccggagcaggtggaggcactggagcgcgtctacagcgagtgccccaagcccagctcgctgcgccggcagcacctcatcagggactgccccatcctccgcaacatcgagcccaagcagatcaaggtctggttccagaaccgcagatgccgggagaagcagcgcaaggagtcctctcgtctacaaaccgtgaaccggaagctgagtgcgatgaacaagctgttgatggaggagaatgaccggctgcagaagcaggtttcccgtctcgtctttgacaacgggtatatgaagaatcgactccacagtccttctgtagccaccaccgacacaagctgtgagtctgtggtgacaagtggtcagcacaaccaacagcaaaacccagcagttctgcatcctccacaaagggatgcgaacaacccagcaggtctactcgctattgctgaggagacattggcagagttcatgtccaaggcgactggaactgctgtcaactgggtgcaaatggttgggatgaagcctggtccggattccgttggaatcatcgctgtttcgcacaactgcagcggcgtagcagcacgagcttgcggccttgtgagccttgagcccacaaaggttgctgagatcctttaggatcgtgcatcgtggtatcgcgattgtcggcatgttg

SEQ ID NO: 901 - DNA, 380 bp, Zea mays
aggagaatgaccggctgcagaagcaggtttcccgtctcgtcttggacaacgggtatatgaagaatcgactccacagtccttctgtagccaccaccgacacaacctgtgagtccgtggtgacaagtggtcagcacaaccaacaacccagcagttctgcatcctccacaaagggatgcgaacaacccagcaggtctactcgctattgctgaggagacattggcagagttcatgtccaaggcgactggaactgctgtcaactgggtgcaaatggttgggatggagcctggtccggattccgcgctgtttcgcacaactgcagcggcgtagcagcacgagcttgcggccttgtgagccttgagcccacaaaggtcaactctgta

SEQ ID NO: 902 - DNA, 1102 bp, Zea mays
ctcttcctctcctctcctcgctaggagccccaagcgagcacgccgcccaccacgatgccagcgcgcacgggagccggccgctccgcctccgcctcctctccgctcccgcaccactagcgcgggagcccgatggcgagcagcagggggaggctgaggctctccccgcgcgcggcggcggcgccgcagctggacgcgggcaagtacgtgcggtacacggcggagcaggtggaagcgctggagcgcgcctacggcgagtgccccaagcccagctcgctgcgccggcagcagctcatccgggactgccccgtcctcaccaacgtcgagcccaggcagatcaaggtctggttccagaaccgcagatgccgggagaagcagcggagggagtcctctcgtctgcagaccgtgaaccggaagctgggtgccatgaacaagctgttgatggaggagaacgaccggctgcagaagcaggtgtcccgtctcgtcttcgacaacgggtatatgaagaatcggctccacagtccttctgtagccaccaccgacacaagctgcgagtctgtggtgacaagtggtcagcacaaccagcagcaaaacccagcagttctgcatcctccacaaagggatgcgaacaacccagcagggtaataagtctggaacacggttgcatttcgttttcaaactctatgcctgctctaatgctagtttcccagtctactcgctattgctgaggagacattggcggagttcatgtccaaggcgaccggaactgctgtcaactgggtgcagatggttgggatgaagcctggtccggattccgttggaatcatcgctgtttcgcacaactgcagcggcgtagcagcacgagcttgcggccttgtgagcctcgagcccacaaaggttgccgagatccttaaggatcgcgcatcgtggtatcgcgattgtcggcgtgttgatatcctccatgttatccctacgggtaacggtggaacgattgagctgatctatatgcagacttatgcactgacaactctggcggaaccgcgcgacttttggacactacgatacactagtggtcttgacgatggcagtcttgtgatctgcaaaa

SEQ ID NO: 903 - DNA, 474 bp, Zea mays
atgtatgagatgcacccggctttgttccttaaaaccgggtgttacatgcatcctcagcgggacgcgaataacctagctggactactagctattgctgaggagaccttggcagagttcctgtcgaaagcaacaggaactgttgtcgattgggtgcaaatggttgggatgaagcctggtccggattccattggaatcatcgttgtttcgcacaattgcagtggcgtagtagcccaagcagatcaaggtctggttccagaaccgcagattattccggacaggagaagctttttggaaaaacagactaagcgcggaccgttcgggcccttgcggcggaccgtccgcgacaccaggatgaccctcggacagaaccaatgcaaaaacccaagtctacactacggaccgtccggagggcaagcaagcaccgtccgagaccacgcgcggaccgtctggcctcaggcgcggaccgtccgatag

SEQ ID NO: 904 - DNA, 2523 bp, Zea mays
atggctgcagcggtggcgatgcgagggggaagcagcgacagcggaggatttgacaaggttcccgggatggactcggggaaatacgtgcgctacaccccggagcaagttgaggtgctcgagcggctctacatcgattgccccaagccaagctcctcacggcggcagcaactgctgcgcgagtgtcctatactctccaacattgagccgaagcagatcaaggtctggttccagaaccgaaggtgccgcgataagcagcggaaggagtcttcgcggcttcaggctgtcaacagaaagctgacggcaatgaacaagcttcttatggaagagaatgagcgtcttcagaagcaagtctctcagttggttcatgaaaatgcgcacatgcggcagcagctgcagaacacttcattggccaatgatacaagctgtgaatcaaatgtcactgcccctccaaacgctataagggatgcaagtaacccttctggactccttgcgattgcggaggagaccttcacagagttcctctcaaaggctactgggacagctattgattgggtccagatgcctgggatgaagcctggtccggattcggttggtattgtggccatttcacatggttgccgtggcgttgctgcccgcgcctgtggtttggtgaatctagaaccaacaaaagtcatagaaatcttgaaagatcgtccctcttggttccgtgattgtcgaagtctggaagtgtttacaatgtttccagctggaaatgggggaacaattgaacttatctacatgcagatgtacgccccaacaactttagttcctgcacgtgacttttggacgttgcgatacacgacaacaatggaagatggcagccttgtggtctgtgagagatccttgactggttctggaggcggtccaaatgcagcttctgcacagcaatttgttagggctgagatgcttccaagtgggtatttagtgcgcccatgcgaaggtggaggttcgattgtgcatatagtggaccatctagatcttgaggcatggagtgttcctgaagtgcttcgaccactatatgagtcttctagagtagttgctcagaaaatgactactgtggcactgcgccaccttagacaaattgctcaagaaacaagtggagaagtagtgtatgccttgggaaggcaacctgcagttctacggacctttagtcaaagactaagcagggggtttaatgatgccattagtggtttcaacgatgatggttggtctgtaatggggggagatggcattgaagacgttgttgttgcttgcaactcaaccaagaaaattaggaataatagcaatgctgggattacatttggagcgcctggaggcattatttgtgcgaaggcatccatgttactgcagagcgtcccaccggcagtactggtccgatttctgagggagcatagatctgaatgggccgattacaatattgatgtgtatttggcttcatcactgaagaccagtgcgtgctcacttcctgggttgcgacccatgagattttctggggggcagatgatcatgccacttgctcacacagtggagaacgaggagattcttgaagttgtccgccttgaaggacaacctcttactcatgatgaagcccttctttcaagggacatccaccttctccagctttgcactggaatagatgagaaatctgtgggttcctccttccagcttgtgtttgcaccaattgatgagcattttccggatgatgctccattgatttcctctggctttcgtgtcataccacttgatatgaaaacagatggtgtatcctctggtaggacgctagatttggcatctagtcttgatgtgggttctgctgcaccccaagcctcaggggatgcacctccagatgactgtaatttgagatctgtgctgacaatcgcctttcaattcccttatgagatgcaccttcaggacagtgttgctactatggcccgtcaatatgtgcgtagtgttgtttctgctgtgcaaagggtgtcgatggctatatctccctcccaatctggtctaaatgctgggcagaggatgctttccggcttccctgaagctgccacacttgctagatgggtttgccagagttatcactaccatctaggtgtggaattacttaaccaatcagatgaagctggtgaagcattgttgaaaatgctctggcatcatccagatgctattctgtgctgctcttttaaggagaaacctatgtttacgtttgcaaacaaggcagggctcgacatgttagaaacatctcttattgcgctgcaagacctgacgctagacaagatcttcgacgagtcaggaaggaaagcaatattctcagatatctcaaaactaatggaacagggctacgcgtacctgccgtcgggcgtgtgcatgtcaggaatgggtcggcatgtctcattcgaccaagctgtagcgtggaaggtgctcggcgaggacagcagcgtccactgcctggcgttctgcttcgtcaactggtccttcgtttga

SEQ ID NO: 905 - DNA, 2571 bp, Zea mays
atgtcgacggcgctggcggtggtcgggggcggcaaggaccggccgtcgcccggcggcggcggggcgccgcaggtggacacgggcaagtacgtgcgctacacccccgagcaggtcgaggcgctcgagcgcgtctacagcgagtgccccaaacccagctcgctgcgcaggcagcagctcatcagggagtgccccatactcagcaacatcgagcccaagcagatcaaggtctggttccagaaccgcagatgccgcgagaagcagcggaaggaggcctcgcgcctgcagactgtgaaccggaagctgactgcgatgaacaagctgttgatggaggagaatgacaggctgcagaagcaggtctcccgactcgtgtacgagaatggatacatgcgacagcagcttcacaatccttctgctgcgactacagacacgagctgtgagtctgtggtcacaagtggtcagcaccaccaacagcaaaacacagcagctccgcgtcctcaacgggatgcaaacaacccagctggtctcctagctatcgctgaggagaccttggcagagttcttgtcaaaagcgacaggaactgctgtcgattgggtgcaaatggttgggatgaagcctggtccggattccattggaatcatcgctgtttcgcacaattgtagtggcgtagcagcccgagcttgcggcctagtgagccttgagcccacaaaggtcgcggagatcctcaaggatcgcccttcttggtaccgcgattgtcggtgtgtggatattctccatgttatccctacgggtaatggtggaactatcgagcttatctacatgcagacttacgcaccgacaactttggcggcaccgcgcgacttttggactctccgatacactagtggtcttgaggatggcagtcttgtgatctgtgagagatcactgacacaatcgactggaggtccatcaggacccaacactccaaattttgtaagagccgaagtgcttcctagtggctatctaattcgaccctgtgagggaggtggctccatgattcacattgtggatcatgttgatttagatgcttggagtgtgcctgaggtccttagaccactttatgaatccccaaagattcttgcacagaaaacaactattgctgcactgcgtcacattaggcaaattgcgcatgaatcgagtggggaaatgccctatggagggggccgacagccagcagttttgagaacatttagccagaggcttagcaggggtttcaatgatgctgtcaatgggtttccagatgacggttggtcactgatgagcagtgacggtgctgaggatgttactattgctatcaactcttctccaaacaaacttattggtcctcatgtcaactcttcccagctgtttactgcgatcggaggtggcatcctgtgtgctaaggcatcaatgctgcttcagaatgtgccacctgccctactagtacgatttctgagggagcatcgctccgaatgggctgatcctggtgttgatgcttattctgccgctgctctgagggctagtccatatgcagttcctggcttgcgtgctagtgggtttatgggcagccaggttattctgccgcttgcacataccttagagcatgaagagttcttggaggttattaggcttgagggacacagcctctgccatgacgaagttgttctgtcacgagatatgtatcttctgcagttgtgcagcggtgtggatgaaaatgcagctggtgcatgtgcacagcttgtgtttgcacccatcgatgaatcttttgccgacgatgcgccactgctaccctcaggcttccgtgtcattccactggatgcaaagacggatccaccatcaggcacacgcacacttgaccttgcatctaccctcgaggttggatctggtgggacaacgcgtgcttcgagtgacgcctccagcacctgcaacacaagatcagtgctgaccattgctttccagttctcatatgaaaatcacctacgagagagcgtcgcagccatggccaggcaatacgtcaggactgtggtggcatcggtgcagagggtagccatggcaatagctccttcgcgcattggtggacagcttgaaatgaagcaaactccaggatctcctgaggcacacacgctggcaaggtggatcggcaggagctacaggttccacactggagccgaactcctccgcacggacacccaatgcacggatgcttccttgaaagcgctgtggcaacactcggactcgatcatgtgctgttccctgaaggctgctcccgtgttcacctttgccaaccaagccggcctggacatgctggagacgacgctgattgctctccaggacatctcccttgagaagatccttgacgacgatggcaggaaggcgctctgcaccgagtaccctaagattatgcaacagggcttcgcgtacctccccggtggcgtgtgtgtgtcgagcatggggcggccggtgtcgtacgagcaggcggtggcgtggaaggtcctgagcgacgacgacaccccgcactgccttgccttcatgttcgtgaactggtccttcgtgtga

SEQ ID NO: 906 - DNA, 2565 bp, Zea mays
atggcgagcagcagggggaggctgaggctctccccgcgcgcggcggcgccgcagctggacgcgggcaagtacgtgcggtacacggcggagcaggtggatgcgctggagcttgcctacggcgagtgccccaagcccagctcgctgcgccggcagcagctcatccgggactgcgccgtcctcaccaacgtcgagcccaggcagatcaaggtctggttccagaaccgcagatgccgggagaagcagcggagggagtcctctcgtctgcagaccgtcaaccggaagctgggtgccatgaacaagctgttgatggaggagaacgaccggctgcagaagcaggtgtcccgtctcgtcttcgacaacgggtatatgaagaatcggctccacagtccttctgtagccaccaccgacacaagctgcgagtctgtggtgacaagtggtcagcacaagcagcagcaaaacccagcagttctgcatcctccacaaagggatgcgaacaacccagcaggtctactcgctattgctgaggagacattggcggagttcatgtccaaggcgaccggaactgctgtcaactgggtgcagatggttgggatgaagcctggtccggattccgttggaatcatcgctgtttcgcacaactgcagcggcgtagcagcacgagcttgcggccttgtgagcctcgagcccacaaaggttgccgagatccttaaggatcgcgcatcgtggtatcgcgattgtcggcgtgttgatatcctccatgttatccctacgggtaacggtggaacgattgagctgatctatatgcagacttatgcactgacaactctggcggaaccgcgcgacttttggacactacgatacactagtggtcttgacgatggcagtcttgtgatctgcgaaaggtcattgacccactccactggaggtccttctggacctaaaactccagattttataagagctgaggtgcttcctagtggttatctgattcgaccttgtgatgggggaggttccatgatttacattgtggatcatgttgatctgaatgcttgtagtgtccctgaggttcttcgaccgctctatgaatctcctaagatactggcacaaaagatgactgctgcggcgttgcgtcacattaggcaaattgcacacgaatcaagtggtgaaacgccctatggtgctgggcgacagccagctgttctcagaactttcagtcaaaggctcagcagaggcttcaatgatgctgtgagtggctttccagacgatggctggtcttctttgttgagcagtgatggtgctgaggatatttcaattacaatcaactcatctccaaacaaacttattgggtctgatgtcagcccttccccattcttttctgccatggggggcggcatcatgtgcgcaaaagcgtcaatgctactgcagaatgtgccacctgctctacttgtgcgatttttgagggagcatcgctctgaatgggctgaccctggtgttgatgcttattccgctgcctctctgagggccaacccatataatgttccgggtttaagggctggtgggtttatgggcaaccaggttatactaccccttgcacgcaccgtggagcatgaagagtgcttggaggttattcgacttcaaggacatggctttagccatgacgaggttcttatgtccccggatatgtttcttctgcagttgtgcagcggcatcgatgaggatgcgccgggtgcttgtgcacagcttgtcttcgctcctatcgatgaatcttttgctgacgatgcaccgttgctaccctctggcttccgtgtgataccgcttgatgctaagacggatgtgccatctgccacacgtacccttgaccttgcttctgcgctcgaggtcggatcaggcggaggtctgtgtgctttaagcgatagcgggtcaggcacgcgcagcacgaggtcggtcctgaccatcgccttccagttctcgttcgagaaccacctccgcgagagcgtggcagcgatggccaggcagtatgtcagggcagtgatggcgatcgtgcagagggtggccatggcgatttctccctctcgccttggcccgcatgtcgaactgaagcatccgccaggctctcccgaggcactcgcactagcttcgtggattggcaggagctacagggcgcacactggaacggagatccgctggtcggacactgaagacgcggcgggctctcccctgacgctgttctggaagcacagcgacgccataatctgctgctctctaaagccggctttcacactcaagttcgccaacagcgccggcttcgacatactggagacgacggtcgcgaacgtccaggacctgcagctggaggcggtccttgatgacgggggacagaaggccctggtcgcacagctccccaagatcatgctgcagggcctggcgtacctccccggcggcgtgtgcaggtcgagcatggggcggcaggcgtcgtacgagcaggcggtggcgtggaaggtggtgggcgacgacggcgcgccgcagtgcctggcgctcatgttcgtcaactggaccttcatctga

SEQ ID NO: 907 - DNA, 3823 bp, Zea mays
tgaactatagaacaagtttgtacaaaaaagcaggctggtggccgggccggggcgccctcctgcactctccccactcaacaatcaaccacggcgtcacaaccgcacccctccgaaccctagctagcaccgcgcgccggagccccggagtaggtgcctgcttgccctcctgcggtggccgtcgcgctgccgccgcctgatccgattcgtctagccgtgtcaagcgccaccaccggtgatcgatgcgaggcgccgcgggaggcggctcgggctcgggcaggctgtgaggagaggctgtccgctcgctgcgtcgtgcgcctgtctgcgcgcgcgtctgctccgccgtccgcgccaagccgtccctcgccgaggggggctgcctctcacggccgctcggcctcgccgcgcgtctgcttcccaccacccacgcagggatcctcgcgggctggaggtcgaagcgcgagcggagagctaagagcaacaaggcgacgagatttgtgtggctacgattttgcgttgccgacggaacatgggaacaatggttgcagcggtggcgttgcgagggggaagcagcgatagcggaggatttgataaggttcccgggatggactcgggaaaatacgtgcgctacaccccggagcaagttgaggtgctcgagcggctctacatagattgccccaagccaagctcctcacggcggcagcaactgctgcgcgagtgtcctatactctccaacattgagccaaagcagatcaaggtctggttccagaaccggaggtgccgcgataagcagcggaaggagtcttcgcggcttcaggctgtgaacagaaagttgacggcaatgaacaagcttctaatggaagagaatgagcggcttcagaagcaagtctctcagttggttcatgaaaacgcgcacatgcggcagcagctgcagaatacttcattggccaatgacacaagctgtgaatcaaatgtcactacccctccaaaccctataagggacgcaagtaacccttctggactccttgcgattgcagaggagaccttcacagagttcctctcaaaggctactgggacagctattgattgggtccagatgcctgggatgaagcctggtccggattcagttggtatcgtggccatttcgcatggttgccgtggcgttgctgcccgcgcctgtggtttggtgaatctagaaccaacaaaaggcatagagatcttgaaagatcgtccctcttggttccgtgattgccgaagtcttgaagtgtttacaaggtttccagctggaaatgggggaacaattgaacttatttacatgcagatgtatgccccaacaactttagtccctgcacgtgatttttggacactacgatacacgacaacaatggaagatggcagccttgtggtctgtgagagatccttgagtggttctggtggtggtccaaatgcagcctctacacaacaatttgttagggctgagatgcttccaagtgggtatttagttcgcccatgcgaaggtggaggatcaattgtgcatatagtggaccatctagatctcgaagcatggagtgttcctgaagtgcttcgaccactgtatgagtcttctagagttgttgctcagaaaatgactactgtggcactgcgccaccttagacaaattgctcaagaaacaagtggagaagtagtgtacgccttgggaaggcaacctgcagtcctacggacctttagtcaaagactaagcagggggtttaatgatgccattagcggtttcaatgatgatggctggtctgtaatggggggagatggcattgaagacgttgttattgcttgcaactcaaccaagaaaattaggaataccagcaatgctgggattacatttggagccccaggaggcattatttgtgcgaaggcatccatgttactgcagagcgtcccaccggcagtactggtacgatttctgagggagcatagatctgaatgggctgattacaatattgatgcgtatttggcttcatcattgaagaccagtgcgtgctcacttcctgggttgcgacccatgagattttctgaggggcagatgatcatgccacttgctcacacagttgagaacgaggagattcttgaagttgtccgccttgaaggtcagcctcttactcatgatgaagctcttctttcaagggacatccaccttctccagctttgcactggaatagatgagaaatctgtgggttcctccttccagcttgtgtttgcaccaattgatgagcatttcccagatgatgctccattgatttcttctggctttcgtgtcataccacttgatgtgaaaacagatggtgtatcctctggtaggacgctagatttggcatctagtcttgatgtgggctctgctgcaccccaagcctcaggggatgcatctccagatgactgcagtttgagatctgtgctgacaatcgcctttcaattcccgtatgagatgcaccttcaggacagcgttgcagcaatggcccgtcaatatgttcgtagtgtcatttctgctgtgcaaagagtgtcgatggctatatctccctcccaatctggtctaaatgctgggcataggatgctttctggcttccctgaagctgccacacttgctagatgggtttgccagagttatcactaccatctaggtatggaattacttaatcaatcagatggagctggtgaagcattgttgaaaatgctctggcatcatccagatgctgttctgtgctgctcctttaaggagaaacctatgtttacgtttgcaaacaaggcagggctggacatgttagaaacatctcttgttgccctgcaagacctgacgctagacaagatcttcgacgagtcaggaaggaaagcactattctcagacatctcgaaactaatggaacagggctacgcgtacctgccgtcaggcgtgtgcatgtcaggaatgggccgccatgtttctttcgaccaagctgtagcgtggaaggtgctcggcgaggatagcaacatccactgcctggcgttctgcttcgtcaactggtccttcgtgtgactgacgcccaacccgtcgggtggttatggcgagctgaccctttttttgtatggaaaatcatcagctgtgacaaaaggcatatgttgcatgcactagttgaagaaactggtccaaatgctttttttgtttgtcattccattcagatgttgctaggtgtggagtggaaatggggcaatagtgtcacggttacacatgacccagcattaaccaaacaaccgcgtcgccagtttctttctattcgatcagggagatgcattttctggcaaaaatctcctatttttttgttgcaaaaaaaaaaaaaaaaaatggaactgctgctggacgccgaaaaagcaagacatatgcggaaactcactatggctcgaggaaaatatatgcctacactgtcttcaaaaaacataatgcagttttttttttccaacccaaagcacacttgacacaaagctggagcacatgtaaagaggcacgccaaatgagcaggtagggtctctcgcaaggctgatgccaacaattaaaccgacgacccttcacaacaaaatcacgattctttgttctcatcctgctccagttgaggctccttctctgcagcctcctcaaatgtctctccttggacaagctcagggacgtcgtcatcatcctgtgcagctgcttcagcaccaggtacctgcctctggaaaatctcagccagcttcttaaggttgtccaggttatcagggcccagttggttgataattgatggcagaaggtcttgcatactttttgtct

SEQ ID NO: 908 - DNA, 867 bp, Zea mays
atggctgcagcggtggcgatgcgagggggaagcagcgacagcggaggatttgacaaggttcccgggatggactcggggaaatacgtgcgctacaccccggagcaagttgaggtgctcgagcggctctacatcgattgccccaagccaagctcctcacggcggcagcaactgctgcgcgagtgtcctatactctccaacattgagccgaagcagatcaaggtctggttccagaaccgaaggtgccgcgataagcagcggaaggagtcttcgcggcttcaggctgtcaacagaaagctgacggcaatgaacaagcttcttatggaagagaatgagcgtcttcagaagcaagtctctcagttggttcatgaaaatgcgcacatgcggcagcagctgcagaacacttcattggccaatgatacaagctgtgaatcaaatgtcactgcccctccaaacgctataagggatgcaagtaacccttctggactccttgcgattgcggaggagaccttcacagagttcctctcaaaggctactgggacagctattgattgggtccagatgcctgggatgaagcctggtccggattcggttggtattgtggccatttcgcatggttgccgtggcgttgctgcccgcgcctgtggtttggtgaatctagaaccaacaaaagtcatagaaatcttgaaagatcgtccctcttggttccgtgattgtcgaagtctggaagtgtttacaatgtttccagctggaaatgggggaacaattgaacttatctacatgcagatgtacgccccaacaactttagttcctgcacgtgacttttggacgttgcgatacacgacaacaatggaagatggcagccttgtg

SEQ ID NO: 909 - DNA, 3034 bp, Zea mays
gaacaagtttggtacaaaaaagcaggctggtaccggtccggaattcccgggatctgcactctccccactcaacaatcaaccacggcgtcacaaccgcacccctccgaaccctagctagcaccgcgcgccggagccccggagtaggtgcctgcttgccctcctgcggtggccgtcgcgctgccgccgcctgatccgattcgtctagccgtgtcaagcgccaccaccggtgatcgatgcgaggcgccgcgggaggcggctcgggctcgggcaggctgtgaggagaggctgtccgctcgctgcgtcgtgcgcctgtctgcgcgcgcgtctgctccgccgtccgcgccaagccgtccctcgccgaggggggctgcctctcacggccgctcggcctcgccgcgcgtctgcttcccaccacccacgcagggatcctcgcgggctggaggtcgaagcgcgagcggagagctaagagcaacaaggcgacgagatttgtgtggctacgattttgcgttgccgacggaacatgggaacaatggttgcagcggtggcgttgcgagggggaagcagcgatagcggaggatttgataaggttcccgggatggactcgggaaaatacgtgcgctacaccccggagcaagttgaggtgctcgagcggctctacatagattgccccaagccaagctcctcacggcggcagcaactgctgcgcgagtgtcctatactctccaacattgagccaaagcagatcaaggtctggttccagaaccggaggtgccgcgataagcagcggaaggagtcttcgcggcttcaggctgtgaacagaaagttgacggcaatgaacaagcttctcatggaagagaatgagcggcttcagaagcaagtctctcagttggttcatgaaaacgcgcacatgcggcagcagctgcagaatacttcattggccaatgacacaagctgtgaatcaaatgtcactacccctccaaaccctataagggacgcaagtaacccttctggactccttgcgattgcagaggagaccttcacagagttcctctcaaaggctactgggacagctattgattgggtccagatgcctgggatgaagcctggtccggattcagttggtatcgtggccatttcgcatggttgccgtggcgttgctgcccgcgcctgtggtttggtgaatctagaaccaacaaaaggcatagagatcttgaaagatcgtccctcttggttccgtgattgccgaagtcttgaagtgtttacaaggtttccagctggaaatgggggaacaattgaacttatttacatgcagatgtatgccccaacaactttagtccctgcacgtgatttttggacactacgatacacgacaacaatggaagatggcagccttgtggtctgtgagagatccttgagtggttctggtggtggtccaaatgcagcctctacacaacaatttgttagggctgagatgcttccaagtgggtatttagttcgcccatgcgaaggtggaggatcaattgtgcatatagtggaccatctagatctcgaagcatggagtgttcctgaagtgcttcgaccactgtatgagtcttctagagttgttgctcagaaaatgactactgtggcactgcgccaccttagacaaattgctcaagaaacaagtggagaagtagtgtacgccttgggaaggcaacctgcagtcctacggacctttagtcaaagactaagcagggggtttaatgatgccattagcggtttcaatgatgatggctggtctgtaatggggggagatggcattgaagacgttgttattgcttgcaactcaaccaagaaaattaggaataccagcaatgctgggattacatttggagccccaggaggcattatttgtgcgaaggcatccatgttactgcagagcgtcccaccggcagtactggtacgatttctgagggagcatagatctgaatgggctgattacaatattgatgcgtatttggcttcatcattgaagaccagtgcgtgctcacttcctgggttgcgacccatgagattttctgaggggcagatgatcatgccacttgctcacacagttgagaacgaggagattcttgaagttgtccgccttgaaggtcagcctcttactcatgatgaagctcttctttcaagggacatccaccttctccagctttgcactggaatagatgagaaatctgtgggttcctccttccagcttgtgtttgcaccaattgatgagcatttcccagatgatgctccattgatttcttctggctttcgtgtcataccacttgatgtgaaaacagatggtgtatcctctggtaggacgctagatttggcatctagtcttgatgtgggctctgctgcaccccaagcctcaggggatgcatctccagatgactgcaatttgagatctgtgctgacaatcgcctttcaattcccgtatgagatgcaccttcaggacagcgttgcagcaatggcccgtcaatatgttcgtagtgtcatttctgctgtgcaaagagtgtcgatggctatatctccctcccaatctggtctaaatgctgggcataggatgctttctggcttccctgaagctgccacacttgctagatgggtttgccagagttatcagtaatttccttcccgtgctgtttctgatacctcacctaaatggtttggttcttttttattgtaatctcatagctattcttttgggccccaatacagctaccatctaggtatggaattacttaatcaatcagatggagctggtgaagcattgttgaaaatgctctggcatcatccagatgctgttctgtgctgctcctttaaggtatcagaagagttttactcaagtctgcaatattccaatcttctaaagtagaggcagacccctccacccatgttttaatgctttcacaacgaaattttcgtgctgccttttgtacctaataatagatatctatatatggattatgcatgggagcagatgagcctgcacccttctaaaaaaaaa

SEQ ID NO: 910 - DNA, 3327 bp, Zea mays
cgtcaatatgtgcgtagtgtgtttctgctgtgcaaagggtgtcgatggctatatctccctcccaatctggtctaaatgctgggcagaggatgctttctggcttccctgaagctgccacacttgctagatgggtttgccagagttatcacaattcggcagaggctttaaggctgtcaccttcgacccacgcgtccgcccacgcgtccgcctgctcccgcccctcaatcaatcacgacgccacagccgcacccccgcgaaccctagctcgcagtcgcaccgcgcgccggacgctgaccaggtgcctgctctatctcctgcggtggccgtcgcgctgccgccgccagacccgatccgtccgaccgtgccaagcgccccccctccggcgatcgatgcgaggcgccgcgggaggcggctcgggctcgggcaggctgtgaggagcctgtccgctcgctgcgtcgtgcgcctgccttccctctcacggtcggcctcgccgcgcgtttgctttcccgcccacgcagggatcttcgcgggcggggagttgaagcgcgagatttgcgcggctacgattctgcgttgccgagggagcaagggaaccaatggctgcagcggtggcgatgcgagggggaagcagcgacagcggaggatttgacaaggttcccgggatggactcggggaaatacgtgcgctacaccccggagcaagttgaggtgctcgagcggctctacatcgattgccccaagccaagctcctcacggcggcagcaactgctgcgcgagtgtcctatactctccaacattgagccgaagcagatcaaggtctggttccagaaccgaaggtgccgcgataagcagcggaaggagtcttcgcggcttcaggctgtcaacagaaagctgacggcaatgaacaagcttcttatggaagagaatgagcgtcttcagaagcaagtctctcagttggttcatgaaaatgcgcacatgcggcagcagctgcagaacacttcattggccaatgatacaagctgtgaatcaaatgtcactgcccctccaaacgctataagggatgcaagtaacccttctggactccttgcgattgcggaggagaccttcacagagttcctctcaaaggctactgggacagctattgattgggtccagatgcctgggatgaagcctggtccggattcggttggtattgtggccatttcacatggttgccgtggcgttgctgcccgcgcctgtggtttggtgaatctagaaccaacaaaagtcatagaaatcttgaaagatcgtccctcttggttccgtgattgtcgaagtctggaagtgtttacaatgtttccagctggaaatgggggaacaattgaacttatctacatgcagatgtacgccccaacaactttagttcctgcacgtgacttttggacgttgcgatacacgacaacaatggaagatggcagccttgtggtctgtgagagatccttgactggttctggaggcggtccaaatgcagcttctgcacagcaatttgttagggctgagatgcttccaagtgggtatttagtgcgcccatgcgaaggtggaggttcgattgtgcatatagtggaccatctagatcttgaggcatggagtgttcctgaagtgcttcgaccactatatgagtcttctagagtagttgctcagaaaatgactactgtggcactgcgccaccttagacaaattgctcaagaaacaagtggagaagtagtgtatgccttgggaaggcaacctgcagttctacggacctttagtcaaagactaagcagggggtttaatgatgccattagtggtttcaacgatgatggttggtctgtaatggggggagatggcattgaagacgttgttgttgcttgcaactcaaccaagaaaattaggaataatagcaatgctgggattacatttggagcgcctggaggcattatttgtgcgaaggcatccatgttactgcagagcgtcccaccggcagtactggtccgatttctgagggagcatagatctgaatgggccgattacaatattgatgtgtatttggcttcatcactgaagaccagtgcgtgctcacttcctgggttgcgacccatgagattttctggggggcagatgatcatgccacttgctcacacagtggagaacgaggagattcttgaagttgtccgccttgaaggacaacctcttactcatgatgaagcccttctttcaagggacatccaccttctccagctttgcactggaatagatgagaaatctgtgggttcctccttccagcttgtgtttgcaccaattgatgagcattttccggatgatgctccattgatttcctctggctttcgtgtcataccacttgatatgaaaacagatggtgtatcctctggtaggacgctagatttggcatctagtcttgatgtgggttctgctgcaccccaagcctcaggggatgcacctccagatgactgtaatttgagatctgtgctgacaatcgcctttcaattcccttatgagatgcaccttcaggacagtgttgctactatggcccgtcaatatgtgcgtagtgttgtttctgctgtgcaaagggtgtcgatggctatatctccctcccaatctggtctaaatgctgggcagaggatgctttccggcttccctgaagctgccacacttgctagatgggtttgccagagttatcactaccatctaggtgtggaattacttaaccaatcagatgaagctggtgaagcattgttgaaaatgctctggcatcatccagatgctattctgtgctgctcttttaaggagaaacctatgtttacgtttgcaaacaaggcagggctcgacatgttagaaacatctcttattgcgctgcaagacctgacgctagacaagatcttcgacgagtcaggaaggaaagcaatattctcagatatctcaaaactaatggaacagggctacgcgtacctgccgtcgggcgtgtgcatgtcaggaatgggtcggcatgtctcattcgaccaagctgtagcgtggaaggtgctcggcgaggacagcagcgtccactgcctggcgttctgcttcgtcaactggtccttcgtttgacacgccatcccatggcctgtgtgatgagcaggccaatttttttgtatggtgatcccaatatggggaaaccatcagctgtgacagaaggctttatgttgcatgcactagttgtacgtcttgaatcgagtgtatttatgaagaaattggatactgcgcaaaaaaaaaaaaaaaaaaaaagccgcagaaaaaaaaaaaaaaaaaaaaaaaa

SEQ ID NO: 911 - DNA, 1354 bp, Zea mays
atggcagcagccgtagcgatgcggagcgggagcagcgatggcggcggcgggtacgagaagagcgggatggacacgggcaagtacgtgcggtacacgccggagcaggtggaggcgctggagcgggtgtacgccgagtgccccaagcccagctccgcgcgcaggcagcagctgctacgcgagtgccccatcctctcaaacatcgaggccaagcagattaaagtctggttccagaaccggaggtgccgtgacaagcaacgcaatgagtcttcgaggctccagtccgtgaacagaaagttgactgcaatgaacaagcttctcatggaggagaatgagcgattgcagaagcaggtttcccagctggttcacgagaatgcgtacatgaagcagcagctgcagaatccgtcactggcaactgatgcgagctgtgagtcaaatgcgaccactcctgcaaacctaagggatgcgagtaacccatcagggctccttgcaattgcagaggagaccttgacagagttcctctcaaaggctacagggactgctattgattgggtccagatgcctgggatgaagcctggtccggattcttttggtattgtgaccatttcacatggtggccgtggtgtcgctgcccgtgcctgtggtctggtgaacctagaaccaacaaagaacaccaagctatccaatgacatgtgggtctggctctacatgtcattgagaaaggctggtggtgtaggtgaaaagtgtatctcatgtggcggtacagatgataatatcctgaagatgtatgctcctactactttagttcctgcacgtgacttttggacactgagatacacaaccactatggaggacggcagtcttgtggtctgtgagagatccttaagtggttcaggagatggtcaaagtgctgccacaacacaacaatttgtaagagctgagatgcttcctagtggctatttagttcgccaatgtgagggtgggggctcgattgtgcgaatagtggaccatctggatcttgacgcttggagtgttcctgaagttcttcgtcccctctacgagtcgtctcgggtggttgcccagaagatgacaaccacagcgctacggcaccttagacaaattgctcaagaaacaagtggagaggttgtatatgcgctaggaaggcagccagctgttctacggacatttagtcagaggctgagtagaggctttaatgatgctataagtggtttcaatgatgatggttggtccgttatgtgtggagatggcatggaagatgttatcattgcttgcaactcgaagaagatcaggagcagtagcaatcctgctactggttttggagcccctggacctggag

SEQ ID NO: 912 - DNA, 2214 bp, Zea mays
  misc_feature (391)..(391): n is a, c, g, or t
  misc_feature (430)..(430): n is a, c, g, or t
  misc_feature (442)..(442): n is a, c, g, or t
atggactcgggaaaatacgtgcgctacaccccggagcaagttgaggtgctcgagcggctctacatagattgccccaagccaagctcctcacggcggcagcaactgctgcgcgagtgtcctatactctccaacattgagccaaagcagatcaaggtctggttccagaaccggaggtgccgcgataagcagcggaaggagtcttcgcggcttcaggctgtgaacagaaagttgacggcaatgaacaagcttctaatggaagagaatgagcggcttcagaagcaagtctctcagttggttcatgaaaacgcgcacatgcggcagcagctgcagaattcgatagtgccaggctgccagcaaattaatgccgatgagatgttaagacttcattggnccaatgacacaagctgtgaatcaaatgtcactacccctnccaaccctatangggacgcaagtaacccttctggactccttgcgattgcagaggagaccttcacagagttcctctcaaaggctactgggacagctattgattgggtccagatgcctgggatgaagcctggtccggattcagttggtatcgtggccatttcgcatggttgccgtggcgttgctgcccgcgcctgtggtttggtgaatctagaaccaacaaaaggcatagagatcttgaaagatcgtccctcttggttccgtgattgccgaagtcttgaagtgtttacaaggtttccagctggaaatgggggaacaattgaacttatttacatgcagatgtatgccccaacaactttagtccctgcacgtgatttttggacactacgatacacgacaacaatggaagatggcagccttgtggcatggagtgttcctgaagtgcttcgaccactgtatgagtcttctagagttgttgctcagaaaatgactactgtggcactgcgccaccttagacaaattgctcaagaaacaagtggagaagtagtgtacgccttgggaaggcaacctgcagtcctacggacctttagtcaaagactaagcagggggtttaatgatgccattagcggtttcaatgatgatggctggtctgtaatggggggagatggcattgaagacgttgttattgcttgcaactcaaccaagaaaattaggaataccagcaatgctgggattacatttggagccccaggaggcattatttgtgcgaaggcatccatgttactgcagagcgtcccaccggcagtactggtacgatttctgagggagcatagatctgaatgggctgattacaatattgatgcgtatttggcttcatcattgaagaccagtgcgtgctcacttcctgggttgcgacccatgagattttctgaggggcagatgatcatgccacttgctcacacagttgagaacgaggagattcttgaagttgtccgccttgaaggtcagcctcttactcatgatgaagctcttctttcaagggacatccaccttctccagctttgcactggaatagatgagaaatctgtgggttcctccttccagcttgtgtttgcaccaattgatgagcatttcccagatgatgctccattgatttcttctggctttcgtgtcataccacttgatgatggtgtatcctctggtaggacgctagatttggcatctagtcttgatgtgggctctgctgcaccccaagcctcaggggaatctccagatgactgcagtttgagatctgtgctgacaatcgcctttcaattcccgtatgagatgcaccttcaggacagcgttgcagcaatggcccgtcaatatgttcgtagtgtcatttctgctgtgcaaagagtgtcgatggctatatctccctcccaatctggtctaaatgctgggcataggatgctttctggcttccctgaagctgccacacttgctagatgggagaaacctatgtttacgtttgcaaacaaggcagggctggacatgttagaaacatctcttgttgccctgcaagacctgacgctagacaagatcttcgacgagtcaggaaggaaagcactattctcagacatctcgaaactaatggaacagggctacgcgtacctgccgtcaggcgtgtgcatgtcaggaatgggccgccatgtttctttcgaccaagctgtagcgtggaaggtgctcggcgaggatagcaacatccactgcctggcgttctgcttcgtcaactggtccttcgtgtga

SEQ ID NO: 913 - DNA, 2364 bp, Zea mays
atgggaacaatggttgcagcggtggcgttgcgagggggaagcagcgatagcggaggatttgataaggttcccgggatggactcgggaaaatacgtgcgctacaccccggagcaagttgaggtgctcgagcggctctacatagattgccccaagccaagctcctcacggcggcagcaactgctgcgcgagtgtcctatactctccaacattgagccaaagcagatcaaggtctggttccagaaccggaggtgccgcgataagcagcggaaggagtcttcgcggcttcaggctgtgaacagaaagttgacggcaatgaacaagcttctaatggaagagaatgagcggcttcagaagcaagtctctcagttggttcatgaaaacgcgcacatgcggcagcagctgcagaatacttcattggccaatgacacaagctgtgaatcaaatgtcactacccctccaaaccctataagggacgcaagtaacccttctggactccttgcgattgcagaggagaccttcacagagttcctctcaaaggctactgggacagctattgattgggtccagatgcctgggatgaagcctggtccggattcagttggtatcgtggccatttcgcatggttgccgtggcgttgctgcccgcgcctgtggtttggtgaatctagaaccaacaaaaggcatagagatcttgaaagatcgtccctcttggttccgtgattgccgaagtcttgaagtgtttacaaggtttccagctggaaatgggggaacaattgaacttatttacatgcagatgtatgccccaacaactttagtccctgcacgtgatttttggacactacgatacacgacaacaatggaagatggcagccttgtggcatggagtgttcctgaagtgcttcgaccactgtatgagtcttctagagttgttgctcagaaaatgactactgtggcactgcgccaccttagacaaattgctcaagaaacaagtggagaagtagtgtacgccttgggaaggcaacctgcagtcctacggacctttagtcaaagactaagcagggggtttaatgatgccattagcggtttcaatgatgatggctggtctgtaatggggggagatggcattgaagacgttgttattgcttgcaactcaaccaagaaaattaggaataccagcaatgctgggattacatttggagccccaggaggcattatttgtgcgaaggcatccatgttactgcagagcgtcccaccggcagtactggtacgatttctgagggagcatagatctgaatgggctgattacaatattgatgcgtatttggcttcatcattgaagaccagtgcgtgctcacttcctgggttgcgacccatgagattttctgaggggcagatgatcatgccacttgctcacacagttgagaacgaggagattcttgaagttgtccgccttgaaggtcagcctcttactcatgatgaagctcttctttcaagggacatccaccttctccagctttgcactggaatagatgagaaatctgtgggttcctccttccagcttgtgtttgcaccaattgatgagcatttcccagatgatgctccattgatttcttctggctttcgtgtcataccacttgatgatggtgtatcctctggtaggacgctagatttggcatctagtcttgatgtgggctctgctgcaccccaagcctcaggggaatctccagatgactgcagtttgagatctgtgctgacaatcgcctttcaattcccgtatgagatgcaccttcaggacagcgttgcagcaatggcccgtcaatatgttcgtagtgtcatttctgctgtgcaaagagtgtcgatggctatatctccctcccaatctggtctaaatgctgggcataggatgctttctggcttccctgaagctgccacacttgctagatgggtttgccagagttatcactaccatctaggtatggaattacttaatcaatcagatggagctggtgaagcattgttgaaaatgctctggcatcatccagatgctgttctgtgctgctcctttaaggagaaacctatgtttacgtttgcaaacaaggcagggctggacatgttagaaacatctcttgttgccctgcaagacctgacgctagacaagatcttcgacgagtcaggaaggaaagcactattctcagacatctcgaaactaatggaacagggctacgcgtacctgccgtcaggcgtgtgcatgtcaggaatgggccgccatgtttctttcgaccaagctgtagcgtggaaggtgctcggcgaggatagcaacatccactgcctggcgttctgcttcgtcaactggtccttcgtgtga

SEQ ID NO: 914 - DNA, 2691 bp, Zea mays
atgaacctctccccgcccaagatgtcggagccatcacctgaaagtgacggggaacaaaggtgtctgaactcagagctatggcatgcatgcgcagggccccttgtgtccctgcctgtggttgggagccgggtcgtctactttcctcagggccatagtgagcaggttgctgcatcaactaataaagaagttgatgctcaaatcccaaactatccaaacctacctccacagttaatatgccagcttcataatgtcacaatgcatgctgatgcagagactgaagaggtgtatgcccaaatgacactgcaaccattgagcccggaagagcaaaaggatccttttcttccaattgaattgggtgctggtagcaagcagccaaccaattacttctgcaagacgttgactgcaagtgatacgagtacccatggtggattctctgttccgcgccgagcagctgagaaagtcttccctccattggatttttcacaacagcctccagtgcaagagctggttgcaagagatctgcatgataatgaatggaaatttcgtcatatttttcgtggtcagccaaaaaggcatctactgacgactggttggagtgtttttgtaagcgcgaaaagactagtagcaggggattctatcatatttatctggaatgataataaccagcttctcttgggaattcgccgtgcaagtcgtccacagactgtaatgccctcttctgtgctatcaagcgatagcatgcacattggtcttcttgctgcagcagctcatgctgcagccacaaacagtcgtttcactattttctacaaccctcgggctagcccttctgagtttgtcattccactggctaagtatgtgaaagctgtttaccacacgcgcgtatctgttggaatgcggtttcggatgctttttgagacagaggaatcaagtgtcagaagatacatgggtacaatcacaggcataagtgatctggactcagagcgctggccaaactcgcactggcgttctgtgaaggttggttgggatgagtctacagctggtgataaacagccaagagtttcactctgggagattgagccactgacaacctttccgatgtacccaactgcttttccattaaggctaaagcgtccgtgggcttcaggactacctatgttcaatggtgggaggagcgacgagttcgctcgttattcttctctcatgtggcttcgagatggaaaccgaggggctcagtcactgaacttccagggacttggagcatcaccatggcttcagccaagaatagattatccattgttgagtctgaagccagatacttaccagcagatggctgccgccgcactagaagaaattagagctggggatcatttgaagcaggcatcttctctcctgccagttcagcagactcaaactttgaatggtggattagatcatttgtatggaaatcctgttctacagcagatgcagttccaatctcagcagtcaacactgcaagctgtgcagcaaggttatggtcagaatgcaaacgactctgggtatgttcaaaatcaactgcagcagctgcagctgcaaaagcagcaggagccaccaccaccacagcagcagcagcagacacaagtccttcagcgacaagcacatcaggaaatgcaacagcacctctcagctagttgtcatgatattgctaatgtagcttctggtgtgtccatgtctggatctgcttgtcaatcacaatcttctctgctttctgggtcatcgttctaccaacagaacatctttgatggaaatggtggtccagatctgcatctgcacaacagtttccacaacttttcaagccaagagtcctccaaccttcttaacctcccaagaagtggccaattaatggcatcagagggatggccttcaaagaggttggctgtggaatctcttgctggtcatgagatccaacctctgcagcacaagcttgagaaagttagtcaccagagtactgtgtctcactgttctggcaccttgccgccactatcagcaagagacggttctagtgcccaggcttgtggtacaaatgttcagagtcacctgcttccatcatcatttgcaatccatgatggattgtcaaccatcaggagtggtggtgttggcagtggaactgatgcgataaccatagcttcgttgagatatagtgatgcgaatttgctacctgaaaactccatagcaacttccagttgtttgggtgaatcaggaaccttcaattctcttgacgatgtttgtggtgtaaacccatcacaaggtggaacctttgtgaaggtttacaaatcagggtccctcgggagatcgctcgacatcaccagattcggcagctactacgagttgcgtgtcgagctcgagcggttatttggtctcgaaggccaactggaggaccctgcaagatcaggctggcagcttgtattcgtcgaccgggaaaacgatgttcttctcctcggcgacgacccgtggcaggagtttgtgaatagcgtagggtgcataaagatcctctcgccgcaagacctgcagcagatggcccgcggcggcggaggtgaccttctgtctgcgcctggagcgaggatgctgcagggcagtgtctgtgacgactattctgcaggccacgacgtgcagaacctcaccggcagcattgcgcctgtggtgcctctggactac

SEQ ID NO: 915 - DNA, 4002 bp, Zea mays
aattcggcgcggggcgaaagcaagcaaggagcaccgcaccacgccactccagtactccactccactctcgtcccctcctcgatccagccatggcggcctagcccccccccctcccctagggttctctgccagcccccacccacccaggcgcctcttgccgctcccacccggtggtcgcgctgcccgcgtcgaatgggaggccacccggcgctcggagtcgggcgtgaccgcgcgctgccggaggttccctgagctcggcggcggcgggagcgtggctggtccggagcgcgccgcgcgtgcaatgggaggttcgagtggggttcctgcgagccgccgcggcggtctcggttctgcgagcgcgtggcccatgcttcgcgaagggtagggttgtctgtctgtctagctagctgctagctgcttggtctgatgagctcagctccggcgccccgcctcggcttccccgcgcgcttgctccgtcggctgcccagaacccagcttgcccgctccggcgcttctcttcgcttcttcggggaaaggttggagctttgaggtggtgcgggtgctcagccgaggactccgggcgatgacgcccgcagtggcgcgcgtttgccgcgacagtcctgggttcgggtagcgagttcctcgagcggatttggctgctgctgcgtcctgcgtgggaaggggaggcggcggcggcggcagcagcagaggaaggggaacggttgctctgaagcggagggggagcgggctgacattgcttctgggagcatggcgagcttctaaggacgcgcagctcccgcagcccagccattctcatcgccgcaccttggtgttcttgcccccaggtcgtactggttggtgggagggaacatgaacctctccccgcccaagatgtcggagccatcacctgaaagtgacggggaacaaaggtgtctgaactcagagctatggcatgcatgcgcagggccccttgtgtccctgcctgtggttgggagccgggtcgtctactttcctcagggccatagtgagcaggttgctgcatcaactaataaagaagttgatgctcaaatcccaaactatccaaacctacctccacagttaatatgccagcttcataatgtcacaatgcatgctgatgcagagactgaagaggtgtatgcccaaatgacactgcaaccattgagcccggaagagcaaaaggatccttttcttccaattgaattgggtgctggtagcaagcagccaaccaattacttctgcaagacgttgactgcaagtgatacgagtacccatggtggattctctgttccgcgccgagcagctgagaaagtcttccctccattggatttttcacaacagcctccagtgcaagagctggttgcaagagatctgcatgataatgaatggaaatttcgtcatatttttcgtggtcagccaaaaaggcatctactgacgactggttggagtgtttttgtaagcgcgaaaagactagtagcaggggattctatcatatttatctggaatgataataaccagcttctcttgggaattcgccgtgcaagtcgtccacagactgtaatgccctcttctgtgctatcaagcgatagcatgcacattggtcttcttgctgcagcagctcatgctgcagccacaaacagtcgtttcactattttctacaaccctcgggctagcccttctgagtttgtcattccactggctaagtatgtgaaagctgtttaccacacgcgcgtatctgttggaatgcggtttcggatgctttttgagacagaggaatcaagtgtcagaagatacatgggtacaatcacaggcataagtgatctggactcagagcgctggccaaactcgcactggcgttctgtgaaggttggttgggatgagtctacagctggtgataaacagccaagagtttcactctgggagattgagccactgacaacctttccgatgtacccaactgcttttccattaaggctaaagcgtccgtgggcttcaggactacctatgttcaatggtgggaggagcgacgagttcgctcgttattcttctctcatgtggcttcgagatggaaaccgaggggctcagtcactgaacttccagggacttggagcatcaccatggcttcagccaagaatagattatccattgttgagtctgaagccagatacttaccagcagatggctgccgccgcactagaagaaattagagctggggatcatttgaagcaggcatcttctctcctgccagttcagcagactcaaactttgaatggtggattagatcatttgtatggaaatcctgttctacagcagatgcagttccaatctcagcagtcaacactgcaagctgtgcagcaaggttatggtcagaatgcaaacgactctgggtatgttcaaaatcaactgcagcagctgcagctgcaaaagcagcaggagccaccaccaccacagcagcagcagcagacacaagtccttcagcgacaagcacatcaggaaatgcaacagcacctctcagctagttgtcatgatattgctaatgtagcttctggtgtgtccatgtctggatctgcttgtcaatcacaatcttctctgctttctgggtcatcgttctaccaacagaacatctttgatggaaatggtggtccagatctgcatctgcacaacagtttccacaacttttcaagccaagagtcctccaaccttcttaacctcccaagaagtggccaattaatggcatcagagggatggccttcaaagaggttggctgtggaatctcttgctggtcatgagatccaacctctgcagcacaagcttgagaaagttagtcaccagagtactgtgtctcactgttctggcaccttgccgccactatcagcaagagacggttctagtgcccaggcttgtggtacaaatgttcagagtcacctgcttccatcatcatttgcaatccatgatggattgtcaaccatcaggagtggtggtgttggcagtggaactgatgcgataaccatagcttcgttgagatatagtgatgcgaatttgctacctgaaaactccatagcaacttccagttgtttgggtgaatcaggaaccttcaattctcttgacgatgtttgtggtgtaaacccatcacaaggtggaacctttgtgaaggtttacaaatcagggtccctcgggagatcgctcgacatcaccagattcggcagctactacgagttgcgtgtcgagctcgagcggttatttggtctcgaaggccaactggaggaccctgcaagatcaggctggcagcttgtattcgtcgaccgggaaaacgatgttcttctcctcggcgacgacccgtggcaggagtttgtgaatagcgtagggtgcataaagatcctctcgccgcaagacctgcagcagatggcccgcggcggcggaggtgaccttctgtctgcgcctggagcgaggatgctgcagggcagtgtctgtgacgactattctgcaggccacgacgtgcagaacctcaccggcagcattgcgcctgtggtgcctctggactactgaagaggactgaggcgaaggccgggatctgaagctctgaaccaaaaccggcaatccagcatttgcaggatttgccatccgcaagtcgtttcgttcctgtgttatgatcctctcagtctcaggccctgttgatcgggaataacctagtcgtttaatatagctagatgatgatccatgtatcattatggtaatggacatgctgtacgatagctactgtagctctaaatgcaggcaaggcaagaattgatctatcaaagaacgaatgaatgcaggcactcactgtagaggtgatctagccctgtactcctaagtcctaagatatattctcatagctaaaactgatggttccatgtggcattggcacccaagctattgaaaccagtcacctttgccgattcataaaacaaaaaaaaaaaaaaaaaattggtcctgctgcatgcc

SEQ ID NO: 916 - DNA, 2106 bp, Zea mays
gtcagccaaaaaggcatctactgacgactggttggagtgtttttgtaagcgcaaaaagactagtagcaggggattctatcatatttatctggaatgataataaccagcttctattgggaattcgtcgagcaaatcgtccacagactgttatgccctcttccgtgctatcaagcgatagcatgcacattggtctccttgctgcagcagctcatgctgcagccacaaacagtcgtttcactattttctacaacccccgggccagcccttctgagtttgtgattccactggctaagtatgtgaaagctgtctaccacacacgtgtgtctgttggaatgcggtttcggatgctttttgagacagaggaatcaagcgtcagacgatacatgggtacgatcacatgcataagtgatctggactcagagcgttggccaaattcacactggcgttctgtgaaggttggttgggatgagtctacagctggtgataaacagccaagagtttcactctgggagatgaacactgatggcctttccgatgtacccaactgcctttccattaaggctaaagcgtccgtgggcttcagggctacctatgttcaatggtgggaggagtgatgagttcgctcgttattcttctctcatgtggctccgagatggaaacagaggggctcaatcactgaacttccagggacttggagcatcaccatggcttcaaccaagaatagattatccattattaggtctgaagctagatacttaccagcagatggctgctgctgcactggaagaaattagagctggggatcatttgaagcagatatcttctctcctgccagtgcaacagccacaaaatttgagtggtggattagatcctttatatggaaatcctgttctgcagcagatgcagttccaatctcagcagtcatccttgcaagttgtgcagcaaggttatggtccaaatgcaagcgactctgggttccttcaaaatcagctgcagctgcaaaagcagcaggagccactaccacagcagcagcagcaagctctgcaacaacaatcgcatcaggaaatgcaacatcacctctcagctagctgtcatgatattgctaatgtagcttctggtgtgtctgagtctggatctgcttctcaaacagaatcttctttgctttctgggtcatcgtaccaacagatctatgatggaaacagtggtccaggtctgcatctgcacaacggtttccacaactgttcaagccaagagtcctccaaccttcttaatctctcaagaagtggacaattcatggcatcagagggatggcctttgaagaggttggctgtggaatctctttctggtcatgagctccaacctgtgcagcacaagtttgagaaagtgaatcaccaaagtaatgtgtctcacatttctagcaccttgcccccactgtcagcaagagacagttatagtgcccaggctagtggtacaaatgatcagagtcacctgctttcatcatcatttgcaatccatgatggcttgacagccgtcaggagtggtggtgttggcagtggaactgatgcgataaccatagcttcgttgagatataatgatatgaatttgctacctgaaaaccccatcgcaacttccagttgtttgggcgaatcaggaaccttcaattctctcgacgatgtgtgtggtgtaaacccatcacaaggtggaacctttgtgaaggtttacaaatcagggtcccctgggagatcgctcgacatcaccaggttcagcagctactacgagttacgtagcgagctcgagcggttatttggtcttgaaggccaactggaggaccctgtaagatcaggctggcagcttgtattcgttgaccgggaaaacgatattcttctcgtcggcgatgacccgtggcaggagtttgtgaatagtgtatggtgcataaagatcctctcgccgcaagacgtgcagcagatggtccgcggcggaggcgaccttctgtctacaactggagtgaggacactgcagggcagtgtctgcgatgattattctgcaggccacgacatgcagaatctcaccggcagcatcgcacctgtggtgcctctggactactga

SEQ ID NO: 917 - DNA, 1767 bp, Zea mays
ttcatcagctctacagcacgaaaacatgctggaatcaaacttccttcaggtaagtcaaaatccgtggatttgtctagattcaaccaaccagtagttagcgagcagcagcagccgcaacaacaacacccacgcgtccgaaagtttatgggctcacagtcaatgtcttttgggggctcggtttcgcttaactcgcccactagcaaagatggttctgttgacaacaaagttggtcgtgatgtgcagaaccagtccctttttagccctcaagtcgactcttcctccctactgtacaatatggtacctaatcttacctcaaatgttgctgataataatatatcagcgtttccctctggatcaacatatctgcaaagtccaatgtatggttgtctggatgactcttctggtttattgcaaaatacaggagagaatgatccgacaactagaacttttgttaaggtaagtataatccgagtctactaaaaaacaaatttaagcccttcctcatgtaatcattttttaaaattcaggtttacaagtcaggatcagtggggagatccttggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccgtgggagtcatttgtgaatagtgtatggtacatcaagatactttcacctgaggatgtgcataagatgggaaagccaggaaacgatccacgctacctatcttagctacctatcttaaatcgatacatggagctctttctggctcccatgacgattctgcggcacactgtagcactgttcacgacggcctgctctactgtgctcgcatgttcgcccgtgtcatctgtagcatgcaccaccgtgctcgtcttcagaagacgaactccccgtcgcttgtatccggtgcaggtcaccgctccttcactgatattttgtagatcccaagtacccggtcagtatcagcaactgcgtccgcccacgcgtccggtcagatgttcggcattaagggtcagttggacgaccctgatagatcaggctggcagcttgtatttgtcgacagggagaacgatgtgcttctccttggagacgacccgtgggagtcatttgtgaatagtgtatggtacatcaagatactttcacctgaggatgtgcataagatgggaaagccaggaaacgatccacgctacctatcttagctacctatcttaaatcgatacatggagctctttctggctcccatgacgattctgcggcacactgtagcactgttcacgacggcctgctctactgtgctcgcatgttcgcccgtgtcatctgtagcatgcaccaccgtgctcgtcttcagaagacgaactccccgtcgcttgtatccggtgcaggtcaccgctcctggactgatattttgtaggttccacgtaggaatcagtatcagcaactctatcctagtttgtggtaggctcgcgcggcgctcgttcctgtgtcgcatcaggatcttcggactaaaatgcgtagtcgaaaccgttctcgtgattcgtaagctattcatgtatttgaggattcctcgacatgctttcgacgatgaactgcaataatctgaatgcaggaggattgtttgagatttaaaaaaaaaaaaaaaaaaaaaaaaaaaaaaaaaaaaaaaaaaaaaactcgagagggg

SEQ ID NO: 918 - DNA, 3502 bp, Zea mays
atggaggctcagatccccaactatcctagtctacctccgcagcttatatgccaactgcataatgtgactatgcatgctgatgctgagacagatgaggtgtatgcacagatgacactccagccactcagtccacaagagctcaaggacccatttttgcctgctgagttaggcactgccagcaaccagccaacaaattatttttgtaaaacactaactgcaagtgatacgagtacacatggtgggttctctgttccacgccgagcagctgagaaggtgtttcctccactggatttcaatcagcaacctcccgcacaggagttgattgcaaaagatcttcatggcaacgactggaaatttcgccatatttttcgaggtcagccaaagcggcatcttctgacaacaggttggagtgtctttgttagtgcaaagagactggttgctggcgactctgtcctttttatctggaatgacaacaaccagctgcttctgggaattcgccgggcaaacagaccacaaaccgtcatgccatcatcagtactttctagtgatagcatgcatattggcctgctcgctgctgcagctcatgctgcatcaacaaatagccggtttactatcttctataatccaagagcaagcccttgtgaatttgtcatacccatggctaagtatgtgaaagctgtgtaccatacccgtatatctgtgggcatgcgtttccggatgctttttgagacggaggaatctagtgtaaggcgttatatggggacaattacaggaataagtgatcttgatcctgttcgctggccaaactcgcactggcgctcagtaaaggttggatgggacgagtcaactgctggagagaagcagccaagggtatctctttgggagattgaaccgttgacaacttttccaatgtatccatctccttttgctcttggattaaagcgcccatggcctgcaggcctgccttctttatacggtggaaggggtgatggcttgacctcttctcttatgtggcttcgagacagggcaaacccgggtttccagtcactgaatttcagcgggcttggtatgagtccctggatgcagcctaggctggataattccttacttggtctccaatctgacatgtaccagaccatagcagcagcagcagcattacaaagcactacgaagcaagttccaccttcagcaatgcagttccaacagcctcagaacattgctgatagatctgctcttctatcaagtcagattctgcagcaagtacaacctcggtttcagcaaatttaccctcaaaatctcaacgaaaacaaaattcaaggtcatacacaacctgagtacctccaagtccaacagcagcttcaacgctgccaatcatttaatgagcagaagcctccgatgcatccacagcaacaacagcaggaaccacagcagcagcaatgcgtccaaacaccacaggatcaacaaatgcaagaacagaagcatctgcacaacttccactccttgccagatgcattatcggccttttctcagctttccccagccactcactccccaccttccgcattgcagacagttccagcattctcgcatcaacaaaacttcccagatacaaacattagctctctctcaccatctactggcccttcaatgcatggcatgttggggagattaccttccgaagcagcttcgagcctcccatgtgtggcaatgaacgcccctgtatcggtatctgacccatggtcatccaagagagttgcagtggagtctgttaacccttgtcgacctcatgtttcaccacatatagaacatttggatatggcgacgtgtaacatgccgcagagctctgcactagcaccattacctggacgggaatgcctagtggatgaagatgggtgctctgatcctcaaaatcacctcttgtttggtgttcacatagactcgcattcacttctgatgcaagggggcattccagcccttcagaatgataacagttcaggcactattccatactcaacctccaatttcctgagcccttctgagaacgatttccccttgaatcaaccgctacgcagcgcgggctgcttagatgagtcggattatcttccatgtgcagagaatgccgaacaggcaaatcaacagtttgcaacctttgtgaaggtttacaaatccgggaccgtcggaaggttgctcgacatcactagattcagcagctacgacgagctccgtagcgaggtggggcgtctgtttggcctcgagggccagctggaagaccctctgagatcaggctggcagcttgtatttgttgacagggaggacgatgtccttctggttggcgatgacccatggcaggaattcgtgaacagtgtgtcctgtataaagatactttcaccggaggaggtccagcggatgggaaagccgggcatccagctcctgagctcggctccttcaagaaggctgggcaatggctgcgacagctacgcgagcatgcaggagccgagaggcctggacgctgggatggcgccgcacttgctagctctgcgacttggaacaaagcacgtagatcaaatggagctctgtgctgctccccgtctgatgatgtcttatgtaaaaccttttttttgtcataataacctgtatattgaaactgttcttggctcccacggtatacggctgacgacgagtgacgagggaaactggaatttgggggcatttcacagaattgaaactactgataattccaacttaccgatgcaattccaattccaacttggtcagaccaacattgccgttgctgtcaatgtcacgataattgctaaagctaccttcagtaaaagcaaaaggcagtttgttatgatcctggaaaagttgagagatagatatatagatatgatctctgagggaattcattcaggtgcacctttatgcttgcataatttggcactacttggtgcagacaacgacgccatggaccggtcctcttcctctcatagtctcatgtgctccctgggtccctatctgactgaaacccctgagtgcggccctcccctggcgaagaagaaaaggatggcctcccgttccctgagggcgtccgtaggagcgaaccccggtagcttctctggtgatctctccatcgctttcatcatatcttcggctgggcccccggtccggcaccacttggagcacacgctggccgtccggcaccgggcacgcagccgagcacgaaaccggcacgagcatccccaacgcgtacctgacccaccggccggtcagccgacggcggcgcacgcgcacggaaccgagggcgggcacggcgcgggcgttgggcgtctgcgcgtgatgggccttggagtccgttccgttacgttcacgtgggacgggaaggacgggcggtccaaagctggagggggctacgggcccaagtatttcctgtggaagcaagaaggccgagttcccgctcccgcatgtaaatcagcccagttagcactgcagatgctggctcgtg

SEQ ID NO: 919 - DNA, 3241 bp, Zea mays
gaacaagtttagtacaaaaaagcaggctggtaaattcggcacgagcccgccatccaccccacaccctctcccatctctctctcggtgccctcctcctcctccccagtccgccccacccttccggccctccccctcttttatatccagtaccatggtgatctccgagctcgggtgagctgatgagaatgcggccgatttgaggaaggctgtgggcgcgatggatgcggtttcgggcggattcgcgaggaggctgtagaggttaggttccggtgtcccccggcccggccggtcgtgggagatgagctcctcgtccgcggccagcatcgggcagccgccgccgcccgcgccgccgccggaagaagagaagaagtgcctcaactcggagctgtggcacgcctgcgccggcccgctcgtctgcctccccaccgtcggtacgcgcgtcgtctacttcccgcagggccacagcgagcaggtggcagcgtcgacgaacaaggaggtggacgggcacatccccaactaccccaacctgccgccgcagctgatctgccagctccatgatgtcacaatgcatgcggatgtggagacagacgaagtgtacgcgcagatgacgctgcagccgctcaatccacaagagcagaacgacgcgtacctgcctgccgagatgggaatcatgagcaagcagccgacgaattacttctgcaagacgctgactgcgagcgacaccagcacgcacggcgggttctctgtgccccgtcgtgcggccgagcgcgtcttccccccgctggatttcacacagcagcctccagcacaggagcttattgcacgggatattcatgatgttgagtggaagttcaggcatatcttccgaggccagcccaaaagacacctgctgacgactggctggagtgtgtttgtcagtgctaagagacttgttgctggagattctgtgctattcatatggaatgagaaaaaccagcttttgcttggaatcagacacgctacccggccacagactgtgatgccctcttctgttctttcgagtgacagcatgcacatcggactccttgcagcagcagctcatgctgctgcaacaaacagccgcttcacaattttctataatcctagggcaagtccaacagaatttgttatacccctttcgaaatacatcaaggctgtttttcacacgcggatatcagttgggatgcgattcaggatgttatttgagactgaggaatcaagtgtccgcaggtacatggggacaataacagaagtgagtgatgctgacccagtgcgttggcctagttcctattggagatcagtgaaggttggttgggatgaatcaaccgcaggagaaaggccacctagagtttctctgtgggaaattgagccactgacaacctttcctatgtatccatccctgttcccactgcgagttaagcatccttggtattcaggacttgctgctcttcatgatgacagcaatgctttgatgtggctgagaggagtaaccggtgaagggggctttcattctttgaacttccagtcacctggtataggttcctggggacaacagagactccatccatccttacttagcaatgaccatgatcagtatcaagcagtggttgctgccgcagctgcctcccagtccggtggttatctgaagcagcaattcctacaccttcaacaacctatgcagtccccacaggagcagtgcaatctcaatccgctgttgcagcaacaaatactacagcaagcgagccaacagcagatggttagttctgatgctcaaaatattcagtccgtgctcaacccaggtgctattcagcagcagctccaccaactccagcagatgcagcatactcataatgaccagaagcaaaagattcaaccagatcaacagtaccaagttgctagcagtgcggttctcccgagtccaacatcattaccaagccatttgcgtgaaaaatttggcttctctgatcctaatgtgaactcttccagcttcatcagctctagcagcaacgaaaacatgctggaatcaaacttccttcaggtaagttcaaaatccgtggatttgtctagattcaaccaaccagtagttagcgagcagcagcagccgcaacaacaacaggcatggaagcaaaagtttatgggctcacagtcaatgtcttttgggggctcggtttcgcttaactcgcccactagcaaagatggttctgttgacaacaaagttggtcgtgatgtgcagaaccagtccctttttagccctcaagtcgactcttcctccctactgtacaatatggtacctaatcttacctcaaatgttgctgataataatatatcagcgtttccctctggatcaacatatctgcaaagtccaatgtatggttgtctggatgactcttctggtttattgcaaaatacaggagagaatgatccgacaactagaacttttgttaaggtttacaagtcaggatcagtggggagatccttggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccgtgggagtcatttgtgaatagtgtatggtacatcaagatactttcacctgaggatgtgcataagatgggaaagccaggaaacgatccacgctacctatcttagctacctatcttaaatcgatacatggagctctttctggctcccatgacgattctgcggcacactgtagcactgttcacgacggcctgctctactgtgctcgcatgttcgcccgtgtcatctctactctctagcatgcaccaccgtgctcgtcttcagaagacgaactccccgtcgcttgtatccggtgcaggtcaccgctcctggactgatattttgtaggttccacgtaggaatcagtatcagcaactctatcctagtttgtggtaggctcgcgcggcgctcgttcctgtgtcgcatcaggatcttcggactaaaatgcgtagtcgaaaccgttctcgtgattcgtaagctattcatgtatttgaggattcctcgacatgctttcgacgatgaactgcaataatctgaatgcaggaggattgtttgagatttgtaaaaaaaaaacaaaaaaaaaaaaaaaaaaaaaaaaaaaaaaaaactcgagagggg

SEQ ID NO: 920 - DNA, 813 bp, Zea mays
ataattctgacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagacccattgagatcaggctggcagcttgtattcgtcgaccgtgaggaggacgtccttctcgtgggcgacgacccttggcaggaattcgtgagcacggtgtcctgcataaagatactctcgccgcaggaggtgcagcagatgggcaagcagggcctggagctcctgagctcggcccccgcggcgcggaggctaggtagcagctgcgacggctacgttagcaggcaggagtcgaggagcctaagcaccgggatcgcgtccgtgggttcggtcgagttctgaaacagaaggcaggagctcgttacgcgccccgagcttagtttagggctggcctgtgacggacccgctagctcggctcgcgcttccgatgttttttgcagtccatggcgtcgaggtggaagcagcaccagacccagcattagctctccttccaggttatgtactaccatctaataattctgtccagtcgtatatgacacccaactcccaagtagaagaaactaccagcagccgctgttggtacacatgctgaaacttcgctcttgtatggagaaacactaatccttgtgaatgtagccagctaggctctgtaatgatccatgagttaatagcccttttgttgcctagcacacggcaagcacaaaaaaaaaaaaaaaaaaaa

SEQ ID NO: 921 - DNA, 929 bp, Zea mays
gaattcccgggtcgacccacgcgtccggacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagacccattgagatcaggctggcagcttgtattcgtcgaccgtgaggaggacgtccttctcgtgggcgacgacccttggcagtaagcactgcatgcgacgttgtttcttttttttttctgcattcttcctcacattgcgttggcaacccaaccccacagggaattcgtgagcacggtgtcctgcataaagatcctctccccgcaggaggtgcagcagatggggaagcagggcctggagctcctgagctcggcccccgcgcggaggctcggtagcagctgtgacgactacgtcagcaggcaggagtcgagaagcctgagcaccgggatcgcgtccgtcggttcggtcgagttgggatgagtagcaagatagcgcgcacgcagcagcagcagcaggttacgcatcctcagcctcagggtaggtaggggactgaagggttggtctgcgacttgatgacccacgagctcctcgttgcgcgcttcgttcgcctccatgcgatggatagaagttcagcgcagatcaagccttagctctgcgagctatgtatcatctaataattctgtccgtgtcgtaccatgtcaactcctaagtagaagaattgaagaaactaccagcagccgctgtctggtatacacgctgaaacattttttcttgtatggagaaatactaatcatctggatgtagccaaaaaaaaaaaaaaaaaaaaaaaaaaaaaaaaaaaaaaaaaaaaaaaaaaaaaaaaaaaaaagggcggccgc

SEQ ID NO: 922 - DNA, 734 bp, Zea mays
  misc_feature (577)..(577): n is a, c, g, or t
gaaggggaccgggccccccctcgagttttttttttttttttttttctagaaaagtttagttaccctgagacagctacataaaggttcttatgtttatgacgagagtgtctgtctaatacaagctaaagtacgtcctaaagtttcaggacccatactcacaaatatgattatgtttctttctaaaaaacgtcaaaacgagagagatgcgaacgaatggcatataaagatgagtggaaacgacttcaaatgggaaacaaagggctcccgcgttgagcatgatgagactaacaccgaagcagttctagagatgggtcgggttttgcgggaataacccaccactgccttctccatgatctcccatttgatgcacatcttctggtgatagtatctttatgtaccaaacgttattcacaaatgactcccatgggtcatcgccaaggagaagaatatcattttccttgtcaacgaatacaagctgccagcctgatctaagggggtcttccaacaacccttcgatagcaaacatcttccctaactcttctcgcagctcgtggtagctgctgaatcgggagatgtntaatgaacgcccaaccgaaccagatttataaacctttacaaagttcttggtttggttggacgagttaatctgtccagctccatgcaataactcatgagttgtgtcttgcatgcagctatataaggaattctgaaatcctgaatctgttagtgacata

SEQ ID NO: 923 - DNA, 4218 bp, Zea mays
ccacgcgtccgctcacgcacaggagatcaatgcaaaagatcttcatgtgaccattgaaaaagacagcatatatgtagagggcagagaaaacggtatattctgatctcagggtggagtgtatttgttagagcaaagagactggttgctggcgactctgtcctttttatctggaatgacaacaaccagctgattgtggtaattcgactggcaaacagaccacataccgtcatgccatcatcagtactttctagtgatagcatgcatattggtctgctcgatgctgtagctcatgctgcatcaacaaatagtcggtttactatcttctataatccaagagcaagcccttgtgaatttgtcatacccatggctaagtatgtgaaagctgtgtaccatacctgtctatatatgtccatcaagtttcaatctaaattgcttaagtgcccttgcagttatatggggacaattacaggaataagtgatcttgatcctgttcgctggccaaactcgcactggcgctcagtaaaggtaggtctcgaaacaaacacagctttgtttttcttaatgccattctacatgccttcacacttctttaactgcgtcatgagtgaattccgagttagatggtggtctctactttcatacatatagtagtaagcatgcaaccaattttcgcctgaatcatgcaggttggatgggacgagtcaactgctggagagaagcagccaagggtatctctttgggagattgaaccgttgacaacttttccaatgtatccatctccttttgctcttggattaaagcgcccatggcctgcaggcctgccttctttatacggtacaagtgacagttacacacttagcaactcttccagtatacagcattgaacaatggattatattgatactgcttatgtgctaatgtcactagtcttgtttctgattgttttggtaggtggaaggggtgatggcttgacctcttctcttatgtggcttcgagacagggcaaacccgggtttccagtcactgaatttcagcgggcttggtatgagtccctggatgcagcctaggctggataattccttacttggtctccaatctgacatgtaccagaccatagcagcagcagcagcatttcaaagcactacgaagcaagttccaccttcagcaatgcagttccaacagcctcagaacattgctgatagatctgctcttctatcaagtcagattctgcagcaagtacaacctcggtttcagcaaatttaccctcaaaatctcaacgaaaacaaaattcaaggccatacacaacctgagtacctccaagtccaacagcagcttcaacgctgccaatcatttaatgagcagaagcctccgatgcatccacagcaacaacagcaggaaccacagaagcagcaatgcgtccaaacaccacaggatcaacaaatgcaagaacagaagcatctgcacaacttccactccttgccagatgcattatcggccttttctcagctttccccagccactcactccccaccttccgcattgcagacagttccagcattctcgcatcaacaaaacttcccagatacaaacattagctctctctcaccatctactggcccttcaatgcatggcatgttggggagattaccttccgaagcagcttcgagcctcccatgtgtggcaatgaacgcccctgtatcggtatctgacccatggtcatccaagagagttgcagtggagtctgttaacccttgtcgacctcatgtttcaccacatatagaacatttggatatggcgacgtgtaacatgccgcagagctctgcactagcaccattacctggacgagaatgcctagtggatgaagatgggtgctctgatcctcaaaatcacctcttgtttggtgttcacatagactcacattcacttctgatgcaagggggcattccagcccttcagaatgataacagttcaggcactattccatactcaacctccaatttcctgagcccttctgataacgatttccccttgaatcaaccgctacgcagcgctggctgcttagatgagtcggattatcttccatgtgcagagaatgccgaacaggcaaatcaacagtttgcaacctttgtgaaggttagtgatgtgtctatctcgtggaccatttgctcaacaaaaagttgttccattttgaattctttcccatgaagcaactttgctgacaaatgcgtgcctgagccctataggtttacaaatccgggaccgtcggaaggttgctcgacatcactagattcagcagctacgacgagctccgtagcgaggtggggcgtctgtttggcctcgagggccagctggaagaccctttgagatcaggctggcagcttgtatttgttgacagggaggacgatgtccttctggttggcgatgacccatggcagtaagttccaccaacaagcctaacaagttcctcaccgccttccgttttcgctgtccgtctcctgtttctcatacgtttgttgggctcggtgacgtgcagggaattcgtgaacagtgtgtcctgtataaagatactttcaccggaggaggtccagcggatgggcaagccgggcatccagctcctgagctcggctccttcaagaaggctgggcaatggctgcgacagctacgcgagcatgcaggagccgagaggcctggacgctgggatggcgccggtgggttcggtcgagttctgaagacggcggaggggagcccatggccctcggctcgaggattactctccctcctgtatgtttctgcagcacttgctagctctgcgacttggaacaaagcacgtagatcaaatggagctctgtgctgctccccgtctgatgatgtcttatggtatagactcgtagcagtaactactacatgttgtatacatgccgggcacttcagttcttatcgagtagcaataccgctagtttagtccatccaatcaactacgttcttgttcctatgatcctgttgttgcgatgcagtaaaactttttttttggtcataataacctgtatattgaaactgttcttggctcccacggtatgctgctgacgacgactgacgaggaaaactggaatttggggggatttcacagaattgaaactactgataattccaacttaccgatgcaattccaattccaacttggtcagaccaacattgccgttgctgtcaatgtcacgataattgctaaagctaccttcagtaaaagcaaaaggcagtttgttatgatcctggaaaagttgagagatagatatatagatatgatctctgagggaattcattcaggtgcacctttatgcttgcataatttggcaccacttggtgcagacaacgacgccatggaccggtcctcttcctctcatagtctcatgtgctccctgggtccctatctgactgaaacccctgagtgcggccctcccctggcgaagaagaaaaggatggcctcccgttccctgaggtcagtggtgcatcggtgagctgaatgcgacgccgctctcgccatcacagttcacggatccactatccctgctccgatccacctcacctggggccgccgccgccgcgccgggccttctgggatcgaccggtttggtggctgcctgctccgcctccgcgcggtggatcgtgacaagattctgagtgggagcacgtggagtgcgacggcaatggcggcgtgacacgcgggcgagcacagctcgcccgttcttgtcgacgctctgcgactctgggcaggtcgtccgtaggagcgaaccccggtagcttctctggtgatctctccatcgctttcatcatatcttcggctgggcccccgggtttggatcccggacgggtattgccatccccgccaatcttggccggcttttcgcggtggggaaggtagaaatctctgttgcctcccaaaaatctgtgccctttttggatgtctatcgacaacagtaacacgagcagagaccgtcagctcacacatatctatcgacgacagctcgagatgcacgaggctttgacttgttgcagccttgcaggtacatcaggtaaagtaccagccgtatctggaaaattgttggtcacctgctggcgatgggtgatcatggtcatggaaccctgagaagagattcaactgagaacacaaggaaaacgacggctctggacacgctcctgtccagctctggaaccgtgcggccgc

SEQ ID NO: 924 - DNA, 783 bp, Zea mays
agcagtggtacaacgcagagtactggtaccgtttttttttttttttttttttttttaccgctaattgaggtgaaaaaaatatgacaaaggtgacagggttcaatagtttaggcgccacatggaaccgtcagcttttagatatgagaagatatagagaactacagggctaggtcacctctacagtgagtgcctgcatccatactttcatagagcaattcttgcctgccatttagagcttaggctatggctacacgtagctacaacagctatcgtacaacatgtccattaccataatgatacaatggatctagctatattaacgactaggttatttctgaccaacacaacttgagagaagatagatcataggaaccgaaaagactcgtggacggcaatcctgcggtgctgaattgccggttttggttcagaacttcagtttctggtcttcatctcggtctcagtagtccagaggcaccacaggtgcgatgctgccggtgagattctgcatgtcgtggcctgcagaataatcatcgcagacactgccctgcagtgtcctcactccagttgtagacagaaggtcgcctccgccgcggaccatctgctgcacgtcttgcggcgagaggatctttatgcaccatacactattcacaaactcctgccacgggtcatcgccgacgagaagaatatcgttttcccggtcaacgaatacaagctgccagcctgatcttacagggtccctccagttggccttcaagaccaaataaccgctcgagctcgctacgt

SEQ ID NO: 925 - DNA, 2860 bp, Zea mays
gaagcattgggcggggagggcgttatcacccgtgaagcggaggtgggaacgggggcagtgtgggcggggggggggaagaggaggaactgaactgtttagaggagatccagggggatgggagggtgtcagtaggggaatatgtattcggaggattgttgatctgggaagtggggggaggtgaggagaatggggcagaatggaggaagggggtgggggagatggacgccggggggggcggtagtatctcggaaagaaaagaggaaacggtccgcaagccccccccccgactggttatgaggaggttaggaacacgcaagattgggaaatcggttaaaaggaagtgggcgatgcggggggggaagagaagggggagtggcacgaaggggcggtcaggcgcgcaggaccgggaaaaagaagaggggtccgcgaggggggggcgggggtgggggggggatgtcttacacccacagggtgcggggaagtttaagcgaccaagaacctaaggatgaagaaggcgtcgcccaattagaccgggtgtttctaagcttggctttacggggggcaaacggaggcgggcgggggccggtgaggggggggtggtgttttaagttttggacccccgggggggggcgggctcactagtccccccccccccccccgcttcccaatcggatggttatccgaagcagcaattcctacaccttcaacaacctatgcagtccccacaggagcagtgcaatctcaatccgctgttgcagcagcaaatactacagcaagggagccaacagcagatggttagtcctgatgctcaaaatatccagtccgtgctcaacccaaatgctattcagcagcagctccaacaactccagcagatgcagcatgctcataatgaccagaagcagaagattcaaccagatcagccgtatcaagttcctagcagtgcggttctctcgagtccaacatcattaccaagccatttgcgggaaaaatttggcttttctgatcctaatgtcaactcttccagcttcatcagctctagcagcaacgagaatatgctggaatcaaacttccttcagggaagctcaaaatctgtggatttgtctagattcaaccaacctgtagttagcgagcatcagcagcaacaggcatggaagcaaaagtttatgggctcacagtcgatgtcttttgggggctcggtttcacttaactcacccactaccaaagatggtcctgttgacaacaaaattggtcgtgatgtgcagaaccagaccctttttagccctcaagttgactcttcctccctactgtacaatatggtacctaatttgacctcaaatgttgcggataataatatatcaacgattccctctggatcaacatatctgcaaagtccaatgtatggttgtctggatgactcttctggtttattgcaaaatacaggagagaatgatccgacaactagaacattcgttaaggtttacaagtcaggatcggtggggagatccttggacatcacccggttctctaattatgctgaacttcgagaggaactgggtcagatgttcggcattaagggtcagttggatgaccctgatagatcaggctggcagcttgtatttgtcgacagggagaacgatgtgcttctccttggagacgacccgtgggagtcatttgtgaatagtgtatggtacatcaaaatactttcacctgaggatgtgcataagatgggaaagccaggaaacgatccacgctacctatcttaaattgatacccagagctctttcgggctcccgtgacgattctgtggcacactgtagcactgtccatggcggtccggtgtgctgtgctcccatgttcgctggtgtcacctctagcatgtacaccgtgcgcgtcttcagaactcccccgttacttgtatccggtgcaggccaccgctctggactgatgtcttgtaggttccacttaggaatcagtatcagcgactctatcctagttggtttgtagctcgcacggcactcgttcttgtgtcgcatcgaaatcttcaggctaaatgcttagttgaaactgttcccgtgattcttaagctatctatgtatttgaggattccccggcatgctttcgacgatgaactgcaataattcgaatgcaggaggattgtttgaatgcaaaaaaaaaaaaaaaaaaaaaaaaaaaaaaaaaaaaccatggaaaaaaaaaaaaaaaaaaaaaaaaaaaaaaaaaaaaaaaaaaaaaaaacaaaaaaaaaaaaaaaaaaaacccgaaaaaaaaaaagaaaacgccggggggggggcccgaacccccttacccccggggggggggcgaatgaaactccccgggccggggggataggtttacgggattcaaaaggaatccaggggtttctcgaatctcttttaacaaataaaagtttggccaaacaccccaggccgggatccggaaaaaaagaaccccccccgcgtacaaacctcccacattatcaccaactttggactaacccggaaagagtaccctaaaaaacccaacacgcttaacaaatgtattaaaaggccacatttatggggagaaggggcattttgttgatgttaataaagtttgtcgggaaattttcgtcaaaaatttaaaataaaatcgcaagtttttttagtgaaatgggtgtaagaaaggaaaacctccccaattaatgaccctccaaaaaaaagccccgaaaagggttgtggtggggggttcgccgtttggaaacaaaaccccccatttttaaataggggaacacccgccaacaaatggggaaaaaaccagttgttcggggcggaggggcccgcgtaagggaaccctcccccaa

SEQ ID NO: 926 - DNA, 5838 bp, Zea mays
cgctcctcgcaatccatcatcgtgaatcgcgtccgcttcctcccgctctctccatccgcgaatcgtgtccctcgagtctgggggctcgcaatcccgctcgtgaatcgcgtccgcttcctccatctctctctagccgtgagaaaccgcgtccgcttcctcctgctctctccatctgcgaatcgcgtcctgcaatcccagccgcgagaaactgtgtccgcttcctccgctcattccctgctctctccatccacgaatcgtgtccgcttcctcgaatcacgtatgcttccctactccccaaggttttcttcgccctccgtcgggatccacagattccccatccaccctccgctcggatcgacagacgcaatccctgctctctcctcgccctccgcccggatcaccaggtcatacttatggcgtcgccaccacaaccaaagcagctggtgctcgctatgtcatccacggattcggacctggctgccttggacctccacaccggcgtggaggactcatccatggatctaggcccagctgcctgggacctccgcacccggtgtggaggacatttgcctctgccccttcgcttcccaccctcggtcgctcgcctcagttgtcgaccgcttcctcgccttcgctcaggcttttcccgctggccacaactctaggaccatccacatctactactgggacgttgctgtcgcttaattttcaagtttgctgacattggaacccagtaactatgcaatctgaagggtgagataaagaattatagctatttatctttatttttcttctcatatattcatgtgtgatacttagaccttctttgctttggttcagtggtataatctgcatcttagactgggcggatattattaacgctcacatagttcctggacctaggattgtagatggcttgaagttgaaggtactttatgacatatatgcgtaagccttttgcaattactgagttaaagagaatagtcaatgctacaactgctaatatctaatatattgcatttctcatagtaactattgtgttctggcattgaagggtttacctaaaggaaaggactacttttgcttgctgaaatgagctcagctggcaacctttcttagactacactgctgcggttgtaaagattatcgagcaacatcctgctttgtaataggatctatatcagtaaatcctgcatcttggtctctagcaccgtcgagccctgcattcatccatgccactcttggagtttagatggctgctggaggatatgcccttgggaaacaatataatactcccatttttgtgagtgtgtttttgccattcggttcttgttggatggctcacttgcttcttgttgactggggattaggtgtgttgggttgtggccactagccggcgtcagctaggaacaacaacctgtagtaggtgtcaattgaggcgacattgtgtcaggaagcagaagacatgcacgcaattggtgaatgacaactttgcatctgtgatttggcccaagaaagtatgttctcctttgcgtccaaaatatatggatgggcaggagaggcgagggtcgcctcaccgtagatggaacccacgaggcgcgcaaggagtggcgccggcgcgccttctctggctccttgctccgctccaatggcatcaatgtccatgtgccacatcatggagcggatgcagcacaattggctagtaccaagaagcagaagaagaaaacacctgggagcagtaatgccaaccatggtcatccaagacataagcgtcggcacgcagacaagtaaaacattgatcaaccatggtcattatttttttataactgatacaaccattattttccctatactatagatccatttcccctttaggtttgggaataatacaaaatatggttgtgtaagatagggtttggctttccaatggccttttgaaattcggcacgaggcaaacttgggaatagcagcggccggccggaagcgagcggagaccgaggggagggggtgaagaagcaacgagacgcagcgagcaagcgaaagcataccagagcaccaagcatagggacgcgcgcgcttctccagttctccctccctgccctgcaaggcggctgcaactgttccagctagcccctctcccagcctctgggtcgtagacgtagtagtagcagccgcagcagcagaagcggcggcgagcatgctcttggcacccctccccggcgccgggcggatctgccggagggcggcggccggggcgcttggagcgcggcgctaaccgcgttcgacggacctcgggatctgacgccgggcctcccctaatcggtcgactccatcggtggcggcggcggccgaggcgccagcagccgggtctctcggctccgggacaagggaaagattgcgcttgcgcttgcttgggcgccggccgcgccggtggcggtaatcttcgagagccgcggtcgcggcgcgcggctgaagagaaaaaaaggtgtgtgtgtgtgagagagagaggaggctccctgccctctcgcggtgacttggcgaggagggggagggactgggaaagcgaatggttttcgggaaggcgctgtgatttggcctggaaaggaggaacctttccttcctcttcccgtcctttgccggctcttgtaccgccctcagatcggcgacccggttgtttcttcggcaacgggcggaaatgaggctctcgtcgtcgtccggcagcgtcctgccggctcagccgggctcgccggaagctgtggaggagcacaagtgcctgaactcggagttgtggcatgcttgtgccggcccgcttgtttccttgcccgcggtgggtagccgagttgtgtacttccctcagggccacagcgagcaggtagcagcatcaacaaacaaggaaatagagtctcagatccccaactatcctaatctgccgccacagcttatatgccaacttcataatgtgacgatgcatgctgatgcagagacagatgaggtatatgcacagatgacactacaaccactcaacccgcaagaactgaaggacccatatttacctgcagaattaggttcggccaataaacagccaacaaactatttctgcaaaacattaacagcaagtgataccagtacccatggtgggttctccgttccccgtcgagcagctgagaaagtgtttcctccactggatttcacccagcaacccccatgccaggagttgatggcaaaagatcttcatggcaatgagtggaaattccgtcacatctttcgtggccagccaaagcggcatcttctaactacaggttggagtgtctttgtaagtgcaaagagactcgttgctggcgactctgtcctttttatctggaatgacaataaccagcttctgctgggaattcgtcgtgcaaatcggccacaaactgtcatgccatcttcagtcttatcaagcgatagcatgcatatcggtcttcttgctgcagctgctcatgctgcttcgacaaatagccgatttacaattttttacaacccaagggcaagcccttcagagtttgtcataccactcgtaaagtatgttaaggctgtgtatcatacccgcatatctgtggggatgcgattcaggatgctttttgagacagaagagtctagcgttaggagatacatggggacaattaccggaatctgtgatcttgattctgttcggtggccaaattcacactggcgttctgttaaggttggctgggatgagtcaactgctggtgagcgacaaccaagggtgtcactatgggagattgaacccctgacaactttcccaatgtatccatctccttttccgctcaggctcaagcgtccatggccaacaggcttgccttctctgcatggtgggaaggatgatgacctggctaactctctcatgtggcttcgagataccgcaaatcctggttttcagtcgttaaattttggtggacttggtatgagcccttggatgcagccaaggctggatgctaccttacttggtctgcaacctgacatgtatcaggcgatggccacagctgcttttcaggatgcaacaaagcaggcatcgcccacaatgctgcagttccagcagccccagaacatagctggccgggcttccccgcttctttcaagtcagattttgcagcaagcacatcatcaatttcagcagcaaccgtaccttcaaaacatctctgagagcacaatccaagcacagggtcagtctgagttcctcaagcagcagatccaacgcagccagtcattcaatgagcagaagccccagatgcaacaccagcaagaatcacagcagcagcagcaaccacagtgtctgccagtcccccaacatcagcaaatgcaacaacagattatgaccaactaccagtctatatctaatgcattatcaccgttttctcagctgtcgccagtttctcagtcttcacctatggcgctgcagactatattaccgttctcgcaggcacagagcttcacagacacgaatgtaggttcattgtctccatccaatggtaacaccatgcaaaacacactgaggccgttctcatcagaagcagtttctcacctcagtatgccgaggcccactgcgatacctgtcgcagacccatggtcgtcgaagcgtgtcgcggtggagtctctgcttccttctcggcctcaggtttcatcccagatggaacaattggaccctgcaccagctagtatacctcatagctctgcgttggcaccacttcccggaagagggtgcttggttgaccaagatgtgaactctgatcctcaaaatcatctcttgttcggtgttagtatagactcgcagtcactgctaatgcaagggggcattcctggtctccaaaacgggaatgattcagctgctataccttattccacttccaatttcctcagcccttctcagaatgactttcctctggaccatacactaaattcttcaggctgcttagatgattctgggtacgtcccgccatgttcagataattctgacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagacccattgagatcaggctggcagcttgtattcgtcgaccgtgaggaggacgtccttctcgtgggcgacgacccttggcaggaattcgtgagcacggtgtcctgcataaagatcctctccccgcaggaggtgcagcagatggggaagcagggcctggagctcctgagctcggcccccgcgcggaggctcggtagcagctgtgacgactacgtcagcaggcaggagtcgagaagcctgagcaccgggatcgcgtccgtcggttcggtcgagttgggatgagcagcaagatagcgcgcacgcagcagcagcagcagcaggttacgcatcctcagcctcagggtaggtaggggactgaagggttggtctgcgacttgatgacccacgagctcctcgttgcgcgcttcgttcgcctccatgcgatggatagaagttcagcgcagaccaagccttagctctgcgagctatgtaccatctaataattctgtccgtgtcgtaccatgtcaactcctaagtagaagaattgaagaaactaccagcagccgctgtctggtatacacgctgaaacattttttttcttgtatggagaaatactaatcatctggatgtagccaggcctatgctctctaatggttgatcgggtaatacagcccctcgcacaaaaaaataagtcgacgcggccg

SEQ ID NO: 927 - DNA, 2884 bp, Zea mays
gtcgacccacgcgtccggtctacctccgcagcttatatgccaactgcataatgtgactatgcatgctgatgctgagacagatgaggtgtatgcacagatgacactgcagccactcagtccacaagagctcaaggacccatttttgcctgctgagttaggcactgccagcaaccagccaacaaattatttttgtaaaacactaactgcaagtgatacgagtacacatggtgggttctctgttccacgccgagcagctgagaaggtgtttcctccactggatttcaatcagcaacctcccgcacaggagttgattgcaaaagatcttcatggcaacgactggaaatttcgccatatttttcgaggtcagccaaagcggcatcttctgacaacaggttggagtgtctttgttagtgcaaagagactggttgctggcgactctgtcctttttatctggaatgacaacaaccagctgcttctgggaattcgacgggcaaacagaccacaaaccgtcatgccatcatcagtactttctagtgatagcatgcatattggcctgctcgctgctgcagctcatgctgcatcaacaaatagtcggtttactatcttctataatccaagagcaagcccttgtgaatttgtcatacccatggctaagtatgtgaaagctgtgtaccatacccgtatatctgtgggcatgcgtttccggatgctttttgagacggaggaatctagtgtaaggcgttatatggggacaattacaggaataagtgatcttgatcctgttcgctggccaaactcgcactggcgctcagtaaaggttggatgggacgagtcaactgctggagagaagcagccaagggtatctctttgggagattgaaccgttgacaacttttccaatgtatccatctccttttgctcttggattaaagcgcccatggcctgcaggcctgccttctttatacggtggaaggggtgatggcttgacctcttctcttatgtggcttcgagacagggcaaacccgggtttccagtcactgaatttcagcgggcttggtatgagtccctggatgcagcctaggctggataattccttacttggtctccaatctgacatgtaccagaccatagcagcagcagcagcatttcaaagcactacgaagcaagttccaccttcagcaatgcagttccaacagcctcagaacattgctgatagatctgctcttctatcaagtcagattctgcagcaagtacaacctcggtttcagcaaatttaccctcaaaatctcaacgaaaacaaaattcaaggccatacacaacctgagtacctccaagtccaacagcagcttcaacgctgccaatcatttaatgagcagaagcctccgatgcatccacagcaacaacagcaggaaccacagcagcagcaatgcgtccaaacaccacaggatcaacaaatgcaagaacagaagcatctgcacaacttccactccttgccagatgcattatcggccttttctcagctttccccagccactcactccccaccttccgcattgcagacagttccagcattctcgcatcaacaaaacttcccagatacaaacattagctctctctcaccatctactggcccttcaatgcatggcatgttggggagattaccttccgaagcagcttcgagcctcccatgtgtggcaatgaacgcccctgtatcggtatctgacccatggtcatccaagagagttgcagtggagtctgttaacccttgtcgacctcatgtttcaccacatatagaacatttggatatggcgacgtgtaacatgccgcagagctctgcactagcaccattacctggacgagaatgcctagtggatgaagatgggtgctctgatcctcaaaatcacctcttgtttggtgttcacatagactcacattcacttctgatgcaagggggcattccagcccttcagaatgataacagttcaggcactattccatactcaacctccaatttcctgagcccttctgataacgatttccccttgaatcaaccgctacgcagcgctggctgcttagatgagtcggattatcttccatgtgcagagaatgccgaacaggcaaatcaacagtttgcaacctttgtgaaggtttacaaatccgggaccgtcggaaggttgctcgacatcactagattcagcagctacgacgagctccgtagcgaggtggggcgtctgtttggcctcgagggccagctggaagaccctttgagatcaggctggcagcttgtatttgttgacagggaggacgatgtccttctggttggcgatgacccatggcaggaattcgtgaacagtgtgtcctgtataaagatactttcaccggaggaggtccagcggatgggcaagccgggcatccagctcctgagctcggctccttcaagaaggctgggcaatggctgcgacagctacgcgagcatgcaggagccgagaggcctggacgctgggatggcgccggtgggttcggtcgagttctgaagacggcggagggaagcccaccatggccctcgggtcgaggattactctccctcctgtatgtttctgcagcacttgctagctctgcgacttggaacaaagcacgtagatcaaatggagctctgtgctgctccccgtctgatgatgtcttatggtatagactcgtagcagtaactactacatgttgtatacatgccgggcacttcagttcttatcgagtagcaataccgctagtttagtccatccaatcaactacgttcttgttcctatgatcctgttgttgcgatgcagtaaaactttttttttcataaaaaaaaaaaaaaaaaaaaaaaaaaaaaaaaaaagggcggccgc

SEQ ID NO: 928 - DNA, 2248 bp, Zea mays
gaaaaaccagcttttgcttggaatcagacacgctacccggccacagactgtgatgccctcttctgttctttcgagtgacagcatgcacatcggactccttgcagcagcagctcatgctgctgcaacaaacagccgcttcacaattttctataatcctagggcaagtccaacagaatttgttatacccctttcgaaatacatcaaggctgtttttcacacgcggatatcagttgggatgcgattcaggatgttatttgagactgaggaatcaagtgtccgcaggtacatggggacaataacagaagtgagtgatgctgacccagtgcgttggcctagttcctattggagatcagtgaaggttggttgggatgaatcaaccgcaggagaaaggccacctagagtttctctgtgggaaattgagccactgacaacctttcctatgtatccatccctgttcccactgcgagttaagcatccttggtattcaggacttgctgctcttcatgatgacagcaatgctttgatgtggctgagaggagtaaccggtgaagggggctttcattctttgaacttccagtcacctggtataggttcctggggacaacagagactccatccatccttacttagcaatgaccatgatcagtatcaagcagtggttgctgccgcagctgcctcccagtccggtggttatctgaagcagcaattcctacaccttcaacaacctatgcagtccccacaggagcagtgcaatctcaatccgctgttgcagcaacaaatactacagcaagcgagccaacagcagatggttagttctgatgctcaaaatattcagtccgtgctcaacccaggtgctattcagcagcagctccaccaactccagcagatgcagcatactcataatgaccagaagcaaaagattcaaccagatcaacagtaccaagttgctagcagtgcggttctcccgagtccaacatcattaccaagccatttgcgtgaaaaatttggcttctctgatcctaatgtgaactcttccagcttcatcagctctagcagcaacgaaaacatgctggaatcaaacttccttcaggtaagttcaaaatccgtggatttgtctagattcaaccaaccagtagttagcgagcagcagcagccgcaacaacaacaggcatggaagcaaaagtttatgggctcacagtcaatgtcttttgggggctcggtttcgcttaactcgcccactagcaaagatggttctgttgacaacaaagttggtcgtgatgtgcagaaccagtccctttttagccctcaagtcgactcttcctccctactgtacaatatggtacctaatcttacctcaaatgttgctgataataatatatcagcgtttccctctggatcaacatatctgcaaagtccaatgtatggttgtctggatgactcttctggtttattgcaaaatacaggagagaatgatccgacaactagaacttttgttaaggtttacaagtcaggatcagtggggagatccttggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccgtgggagtcatttgtgaatagtgtatggtacatcaagatactttcacctgaggatgtgcataagatgggaaagccaggaaacgatccacgctacctatcttagctacctatcttaaatcgatacatggagctctttctggctcccatgacgattctgcggcacactgcagcactgttcacgacggcctgctctactgtgctcgcatgttcgcccgtgtcatctctactctctagcatgcacaccgtgctcgtcttcagaagacgaactccccgtcgcttgtatccggtgcaggtcaccgctcctggactgatattttgtaggttccacgtaggaatcagtatcagcaactctatcctagtttgtggtaggctcgcgcggcgctcgttcctgtgtcgcatcaggatcttcggactaaaatgcgtagtcgaaaccgttctcgtgattcgtaagctattcatgtatttgaggattcctcgacatgctttcgacgatgaactgcaataatctgaatgcaggaggattgtttgagatttgtaaaaaaaaaaaaaaaaaggaaactcgagg

SEQ ID NO: 929 - DNA, 1306 bp, Zea mays
ggtggtccagatctgcatctgcacaacagtttccacaacttttcaagccaagagtcctccaaccttcttaacctcccaagaagtggccaattaatggcatcagagggatggccttcaaagaggttggctgtggaatctcttgctggtcatgagatccaacctctgcagcacaagcttgagaaagttagtcaccagagtactgtgtctcactgttctggcaccttgccgccactatcagcaagagacggttctagtgcccaggcttgtggtacaaatgttcagagtcacctgcttccatcatcatttgcaatccatgatggattgtcaaccatcaggagtggtggtgttggcagtggaactgatgcgataaccatagcttcgttgagatatagtgatgcgaatttgctacctgaaaactccatagcaacttccagttgtttgggtgaatcaggaaccttcaattctcttgacgatgtttgtggtgtaaacccatcacaaggtggaacctttgtgaaggtttacaaatcagggtccctcgggagatcgctcgacatcaccagattcggcagctactacgagttgcgtgtcgagctcgagcggttatttggtctcgaaggccaactggaggaccctgcaagatcaggctggcagcttgtattcgtcgaccgggaaaacgatgttcttctcctcggcgacgacccgtggcaggagtttgtgaatagcgtagggtgcataaagatcctctcgccgcaagacctgcagcagatggcccgcggcggcggaggtgaccttctgtctgcgcctggagcgaggatgctgcagggcagtgtctgtgacgactattctgcaggccacgacgtgcagaacctcaccggcagcattgcgcctgtggtgcctctggactactgaagaggactgaggcgaaggccgggatctgaagctctgaaccaaaaccggcaatccagcatttgcaggatttgccatccgcaagtcgtttcgttcctgtgttatgatcctctcagtctcaggccctgttgatcgggaataacctagtcgtttaatatagctagatgatgatccatgtatcattatggtaatggacatgctgtacgatagctactgtagctctaaatgcaggcaaggcaagaattgatctatcaaagaacgaatgaatgcaggcactcactgtagaggtgatgtagccctgtactcctaagtcctaagatatattctcatagctaaaactgatggttccatgtggcattggcacccaagctattgaaaccagtcacctttgccgattctt

SEQ ID NO: 930 - DNA, 754 bp, Zea mays
  misc_feature (68)..(68): n is a, c, g, or t
aagtccaatgtatggttgtctggatgactcttctggtttattgcaaaatacaggagagaatgatctgncaactagaacattcgttaaggtttacaagtcaggatcggtggggagatccttggacatcacccggttctctaattatgctgaacttcgagaagaactgggtcagatgttcggcattaagggtcagttggatgaccctgatagatcaggctggcagcttgtatttgtcgacagggagaacgatgtgcttctccttggagacgacccctgggagtcatttgtgaatagtgtatggtacatcaaaatactttcacctgaggatgtgcataagatgggaaagccaggaaacgatccacgctacctatcttaaattgatacccagagctctttcgggctcccgtgacgattctgtggcacactgtagcactgtccatggcggtccggtgtgctgtgctcgcatgttcgcccgtgtcatctatagcatgtacaccgtgcgcgtcttcagaactcccccgttacttgtatccggtgcaggccaccgctctggactgatatcttgtaggttccacttaggaatcagtataagcgactctatcctagttggtttgttgaaactgttcccgtgattcttaagctatctatgtatttgaggattcctcggcatgctttcgacgatgaactgcaataatttgaatgcaggaggattgtttgaaaaaaaaaaaaaaaaaaaaaaaactcgagaaggggc

SEQ ID NO: 931 - DNA, 412 bp, Zea mays
cagctacgacgagctccgtagcgaggtggggcgtctgtttggcctcgagggccagctggaagaccctctgagatcaggctggcagcttgtatttgttgacagggaggacgatgtccttctggttggcgatgacccatggcaggaattcgtgaacagtgtgtcctgtataaagatactttcaccggaggaggtccagcggatgggaaagccgggcatccagctcctgagctcggctccttcaagaaggctgggcaatggctgcgacagctacgcgagcatgcaggagccgagaggcctggacgctgggatggcgccgcacttgctagctctgcgacttggaacaaagcacgtagatcaaatggagctctgtgctgctccccgtctgatgatgtcttatggtatagactcgtag

SEQ ID NO: 932 - DNA, 922 bp, Zea mays
ttaccaagcctttgcgtgaaaaatttggcttctctgatcctaatgtgaactcttccagcttcatcagctctagcagcaacgaaaacatgctggaatcaaacttccttcaggtttacaagtcaggatcagtggggagatccttggacatcacccggttctctaattatgctgaacttcgagaggaactgggtcagatgttcggcattaagggtcagttggacgaccctgatagatcaggctggcagcttgtatttgtcgacagggagaacgatgtgcttctccttggagacgacccgtgggagtcatttgtgaatagtgtatggtacatcaagatactttcacctgaggatgtgcataagatgggaaagccaggaaacgatccacgctacctatcttagctacctatcttaaatcgatacatggagctctttctggctcccatgacgattttgcggcacactgcagcactgttcacgacggcctgctctactgtgctcgcatgttcgcccgtgtcatctctactctctagcatgcacaccgtgctcgtcttcagaagacgaactccccgtcgcttgtatccggtgcaggtcaccgctcctggactgatattttgtaggttccacgtaggaatcagtatcagcaactctatcctagtttgtggtaggctcgcgcggcgctcgttcctgtgtcgcatcaggatcttcggactaaaatgcgtagtcgaaaccgttctcgtgattcgtaagctattcatgtatttgaggattcctcgacatgctttcgacgatgaactgcaataatctgaatgcaggaggattgttcgagatttgtacttcaaaaaaaaaaaaaaaaaaaaaaaaaaaagggcggccgctctagagtatccctcgaggggccctaagcttacgcgtaccctagcttt

SEQ ID NO: 933 - DNA, 1094 bp, Zea mays
cccacgcgtccggggctcacagtcgatgtcttttgggggctcggtttcacttaactcacccactaccaaagatggtcctgttgacaacaaaattggtcgtgatgtgcagaaccagaccctttttagccctcaagttgactcttcctccctactgtacaatatggtacctaatttgacctcaaatgttgcggataataatatatcaacgattccctctggatcaacatatctgcaaagtccaatgtatggttgtctggatgactcttctggtttattgcaaaatacaggagagaatgatccgacaactagaacattcgttaaggtttacaagtcaggatcggtggggagatccttggacatcacccggttctctaattatgctgaacttcgagaggaactgggtcagatgttcggcattaagggtcagttggatgaccctgatagatcaggctggcagcttgtatttgtcgacagggagaacgatgtgcttctccttggagacgacccatgggagtcatttgtgaatagtgtatggtacatcaaaatactttcacctgaggatgtgcataagatgggaaagccaggaaacgatccacgctacctatcttaaattgatacccagagctctttcgggctcccgtgacgattctgtggcacactgtagcactgtccatggcggtccggtgtgctgtgctcgcatgttcgcccgtgtcatctatagcatgtacaccgtgcgcgtcttcagaactcccccgttacttgtatccggtgcaggccaccgctctggactgatatcttgtaggttccacttaggaatcagtatcagcgactctatcctagttggtttgtagctcgcacggcactcgttcttgtgtcgcatcgaaatcttcaggctaaatgcttagttgaaactgttcccgtgattcttaagctatctatgtatttgaggattccccggcatgcttttgacgatgaactgcaataatttgaatgcaggaggattgtttgaatgctaaaaaaaaaaaaaaaaaaaaaaaaaaaaaaaagggcggccgctctagagtatccctcgaggggcccagagcttacgcgta

SEQ ID NO: 934 - DNA, 2301 bp, Zea mays
atgaggctctcgtcgtcgtccggcagcgtcctgccggctcagccgggctcgccggaagctgtggaggagcacaagtgcctgaactcggagttgtggcatgcttgtgccggcccgcttgtttccttgcccgcggtgggtagccgagttgtgtacttccctcagggccacagcgagcaggtagcagcatcaacaaacaaggaaatagagtctcagatccccaactatcctaatctgccgccacagcttatatgccaacttcataatgtgacgatgcatgctgatgcagagacagatgaggtatatgcacagatgacactacaaccactcaacccgcaagaactgaaggacccatatttacctgcagaattaggttcggccaataaacagccaacaaactatttctgcaaaacattaacagcaagtgataccagtacccatggtgggttctccgttccccgtcgagcagctgagaaagtgtttcctccactgcaacccccatgccaggagttgatggcaaaagatcttcatggcaatgagtggaaattccgtcacatctttcgtggccagccaaagcggcatcttctaactacaggttggagtgtctttgtaagtgcaaagagactcgttgctggcgactctgtcctttttatctgggcaagcccttcagagtttgtcataccactcgtaaagtatgttaaggctgtgtatcatacccgcatatctgtggggatgcgattcaggatgctttttgagacagaagagtctagcgttaggagtctaaccagatcaaatgcattcaattccagatacatggggacaattaccggaatctgtgatcttgattctgttcggtggccaaattcacactggcgttctgttaaggttggctgggatgagtcaactgctggtgagcgacaaccaagggtgtcactatgggagattgaacccctgacaactttcccaatgtatccatctccttttccgctcaggctcaagcgtccatggccaacaggcttgccttctctgcatggtgggaaggatgatgacctggctaactctctcatgtggcttcgagataccgcaaatcctggttttcagtcgttaaattttggtggacttggtatgagcccttggatgcagccaaggctggatgctaccttacttggtctgcaacctgacatgtatcaggcgatggccacagctgcttttcaggatgcaacaaagcaggcatcgcccacaatgctgcagttccagcagccccagaacatagctggccgggcttccccgcttctttcaagtcagattttgcagcaagcacatcatcaatttcagcagcaaccgtaccttcaaaacatctctgagagcacaatccaagcacagggtcagtctgagttcctcaagcagcagatccaacgcagccagtcattcaatgagcagaagccccagatgcaacaccagcaagaatcacagcagcagcagcaaccacagttttctcagtcttcacctatggcgctgcagactatattaccgttctcgcaggcacagagcttcacagacacgaatgtaggttcattgtctccatccaatggtaacaccatgcaaaacacactgaggccgttctcatcagaagcagtttctcacctcagtatgccgaggcccactgcgatacctgtcgcagacccatggtcgtcgaagcgtgtcgcggtggagtctctgcttccttctcggcctcaggtttcatcccagatggaacaattggaccctgcaccagctagtatacctcatagctctgcgttggcaccacttcccggaagagggtgcttggttgaccaagatgtgaactctgatcctcaaaatcatctcttgttcggtgttagtatagactcgcagtcactgctaatgcaagggggcattcctggtctccaaaacgggaatgattcagctgctataccttattccacttccaatttcctcagcccttctcagaatgactttcctctggaccatacactaaattcttcaggctgcttagatgattctgggtacgtcccgccatgttcagataattctgacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagacccattgagatcaggctggcagcttgtattcgtcaaccgtgaggaggacgtccttctcgtgggcgacgacccttggcagtaa

SEQ ID NO: 935 - DNA, 3139 bp, Zea mays
atgaggctctcgtcgtcgtccggcagcgtcctgccggctcagccgggctcgccggaagctgtggaggagcacaagtgcctgaactcggagttgtggcatgcttgtgccggcccgcttgtttccttgcccgcggtgggtagccgagttgtgtacttccctcagggccacagcgagcaggtagcagcatcaacaaacaaggaaatagagtctcagatccccaactatcctaatctgccgccacagcttatatgccaacttcataatgtgacgatgcatgctgatgcagagacagatgaggtatatgcacagatgacactacaaccactcaacccgcaagaactgaaggacccatatttacctgcagaattaggttcggccaataaacagccaacaaactatttctgcaaaacattaacagcaagtgataccagtacccatggtgggttctccgttccccgtcgagcagctgagaaagtgtttcctccactggatttcacccagcaacccccatgccaggagttgatggcaaaagatcttcatggcaatgagtggaaattccgtcacatctttcgtggccagccaaagcggcatcttctaactacaggttggagtgtctttgtaagtgcaaagagactcgttgctggcgactctgtcctttttatctggaatgacaataaccagcttctgctgggaattcgtcgtgcaaatcggccacaaactgtcatgccatcttcagtcttatcaagcgatagcatgcatatcggtcttcttgctgcagctgctcatgctgcttcgacaaatagccgatttacaattttttacaacccaagttgcttttgcagggcaagcccttcagagtttgtcataccactcgtaaagtatgttaaggctgtgtatcatacccgcatatctgtggggatgcgattcaggatgctttttgagacagaagagtctagcgttaggagatacatggggacaattaccggaatctgtgatcttgattctgttcggtggccaaattcacactggcgttctgttaaggttggctgggatgagtcaactgctggtgagcgacaaccaagggtgtcactatgggagattgaacccctgacaactttcccaatgtatccatctccttttccgctcaggctcaagcgtccatggccaacaggcttgccttctctgcatggtgggaaggatgatgacctggctaactctctcatgtggcttcgagataccgcaaatcctggttttcagtcgttaaattttggtggacttggtatgagcccttggatgcagccaaggctggatgctaccttacttggtctgcaacctgacatgtatcaggcgatggccacagctgcttttcaggatgcaacaaagcaggcatcgcccacaatgctgcagttccagcagccccagaacatagctggcggggcttccccgcttctttcaagtcagattttgcagcaagcacatcatcaatttcagcagcaaccgtaccttcaaaacatctctgagagcacaatccaagcacagggtcagtctgagttcctcaagcagcagatccaacgcagccagtcattcaatgagcagaagccccagatgcaacaccagcaagaatcacagcagcagcagcaaccacagtgtctgccagtcccccaacatcagcaaatgcaacaacagaatatgaccaactaccagtctatatctaatgcattatcaccgttttctcagctgtcgccagtttctcagtcttcacctatggcgctgcagactatattaccgttctcgcaggcacagagcttcacagacacgaatgtaggttcattgtctccatccaatggtaacaccatgcaaaacacactgaggccgttctcatcagaagcagtttctcacctcagtatgccgaggcccactgcgatacctgtcgcagacccatggtcgtcgaagcgtgtcgcggtggagtctctgcttccttctcggcctcaggtttcatcccagatggaacaattggaccctgcaccagctagtatacctcatagctctgcgttggcaccacttcccggaagagggtgcttggttgaccaagatgtgaactctgatcctcaaaatcatctcttgttcggtgttagtatagactcgcagtcactgctaatgcaagggggcattcctggtctccaaaacgggaatgattcagctgctataccttattccacttccaatttcctcagcccttctcagaatgactttcctctggaccatacactaaattcttcaggctgcttagatgattctgggtacgtcccgccatgttcagataattctgacaaagtgaaccgaccaccagcgaccttcgtgaaggtttacaaatctggaacctacgggaggtcgcttgatatcactaggtttagcagctatcacgagctccgtagggaactggggcgcctatttggccttgagggccagttggaagacccattgagatcaggctggcagcttgtattcgtcgaccgtgaggaggacgtccttctcgtgggcgacgacccttggcaggaattcgtgagcacggtgtcctgcataaagatcctctccccgcaggaggtgcagcagatggggaagcagggcctggagctcctgagctcggcccccgcgcggaggctcggtagcagctgtgacgactacgtcagcaggcaggagtcgagaagcctgagcaccgggatcgcgtccgtcggttcggtcgagttgggatgagcagcaagatagcgcgcacgcagcagcagcagcagcaggttacgcatcctcagcctcagggtaggtaggggactgaagggttggtctgcgacttgatgacccacgagctcctcgttgcgcgcttcgttcgcctccatgcgatggatagaagttcagcgcagaccaagccttagctctgcgagctatgtaccatctaataattctgtccgtgtcgtaccatgtcaactcctaagtagaagaattgaagaaactaccagcagccgctgtctggtatacacgctgaaacattttttttcttgtatggagaaatactaatcatctggatgtagccaggcctatgctctctaatggttgatcgggtaatacagcccctcgcacacaaaaa

SEQ ID NO: 936 - DNA, 4109 bp, Zea mays
ctcctcgaaggcgaagcaaagctaccaacgcatacaagagtgagagcagggagcacgagcgctctgagtgagtggaagacgagaggagttcgagtcccccagggctagggtttcattcgccacccgcgccgcccttcccttccccagcatccgtccgccatggtgaggaagaaaagaactggccctggagagagttctggggaggcttctggagcgcctggtcatggctcctcacagcgtcctcaggcaacacaacagggtacccgtggtggagggcaacaccagggccgtggtggatatctgggccctggagtgctgccttcacagcacccaggtggtggcccacctgagtatcatcaaccgcttgactaccagggacgtggtggatatcagggccgtggtggaccaccttcacagcatcctggtggtgggacaccccctgggtctcaactgcgtggctaccaggggcacggtggataccagggccgtggcgggccaccttcacagtatcctggtggtgggacaccccctgggtctcaaccacgtgactaccacggacgtggtggtccacgtcccagagggggaatgccacagtcataccgtggcgggcatgtgggaggtagtgttataccaagtgttccttcaggtccatctaggccagttcccgagctgcaccaagccccagatgtccaacatcaagcccctgtggtggcaacaccatcttcgccaggagctggctcgtcctcgcagcctgggaaggctgaggtgagcactggacaagtccagcaacagttccagcaacttgcgattcgtaaccaaagcttagccagccaagctggtcagatggcaccagcgtcaagcaaatctgttaggttcccattgcgccctggcaagggtacgcatgggtccaggtgcattgtgaaggcaaatcatttctttgctgagctgcctaataaagaccttcaccaatacgatgtatcaataacacccgaggttacttcacgcggcgtcaatcgtgctgtcatggcagagctagtaaaactttacagacactcccatttggatgggcgtctgcctgcatacgatggaaggaagagtctttatacagctggagcgttgccatttgcttcgaagacattcgaaattactctgcaagatgaggaagacagtcttggtggaggccaaaggcgccagagggtatttcgggtgaccatcaaatttgctgctcgcgctgatctccaccatttggctatgtttcttgctgggaggcagccagatgcccctcaagaggctcttcaagtacttgacatcgtgctacgtgaaatgcctactgccaagtattgtcctgttggtagatcattttattctcccaagttagggagacctcagcaacttggtgaaggtttggaaacttggcgtggtttctaccaaagcataaggcccacacagatgggtctttctctgaatattgatatgtcctctactgcattttttgaggccctccctgtaattgattttgtttctcagcttcttaatagagatatctcagttagaccattgtctgattctgatcgcgtgaagattaaaaaagccctacgaggtgtgaaagtggaggtcacacaccgtggaaacatgcgtaggaaatatcggatatctggccttactccacaagcaacaagggagttatcattccctattgatgatcgtggtactgttaagactgtggtgcaatacttcctggagacttatggtttcagtattcagcacaccactttaccttgtttgcaagtgggcaatcagcaaagaccaaattatctgcctatggaggtctgtaagatagttgaggggcagcgctactcaaaacgacttaatgataaacagatcactgctctactgaaggtgacttgccaacgtccccaagcgcgtgagaaggacatcttggagactgtgtatcacaatgcctactccaaggatccttatgcccaggaatttggtataacgattgatgagcgtcttgcatcggttgaagctcgtgttctgcctcccccaaggctgaaataccatgatagtggcagagaaagggatgtattgccaaaagttggccagtggaacatgatgaataagaaaatggtcaatggtggtagagttagcagctgggcatgcattaacttctcacggaatgtgcaagatggtgctgccgggggtttctgtcatgaattggctttgatgtgccaagtatcaggaatggattttgtacttgaacctgtgctgtcaccttgctatgcaaggcctgaacttgttgaaagagcactaaagggacgctatcaagatgcgatgaacatactcgggcctcagggccgagaactcgacttgctgattgttatactgcctgacaataatggttctctttacggggatgtcaaaaggatctgtgagactaatcttggattggtctcccaatgctgtctgactaaacatgttttcaaggtgaacaagcagcagtatcttgcaaatgttgccctgaaaataaatgtgaaggttgggggaaggaatactgtgcttgttgatgctttggcaaggagaatcccccttgtcagtgacatagcgactattatctttggtgctgatgtgacccatccccatcctggggaagattctagtccttccattgcagctgtggttgcttctcaagactggcctgaggttacaaagtatgcaggattggtgagtgctcaagcccatcgtcaagaattgatacaggatcttttcaaggtatggcaagatcccgaaagggggactgtctctggtggcatgatcagggagcttctcatatctttctggagggcaactggacagaaaccaaagaggatcatattctacagggatggcgtcagtgagggacaattctaccaagttctgttgtatgaacttgatgccattagaaaggcctgtgcgtcattggagtctgactaccagcctccagttacttttgtcgtggtccagaagcgtcatcacaccaggttgtttgctaataatcacaatgataatcgtgctgtcgataaaagcgggaacatactgcctggcaccgtggtggactcgaagatctgccatccaactgagtttgatttctacctgtgcagccatgctggcattcagggaacaagccgccctgcccattaccatgttctgtgggatgagaacaactttacggctgatgggttgcaaactctcaccaacaacttgtgttacacgtatgctaggtgcacacgctcagtatcgattgttcctcctgcatactatgctcacctggcagccttccgagctcggttctacatggagccagatacgagtgacagtggatctatggcaagccgtggccctccaccaggggggcgcaacaccaaggctgccggtgttgggaatgttgctgtgaggccattacctgccctcaaggaaaacgtgaagcgggtcatgttctactgctaagactgatgctgttaaggcagagctaccttttattattacagtatatcgtgaagactagagtatttttttccacgtacttgatgatgctgagctaccttttattatgtcgtacgatatatatgcgtggtattgtatactggttacagtaactttagttgtgtgttccatcgtgctggtgggcaggtggtgttacgtgaaaaacattctcctctaaaattcatcaaatttggacatagactgaacatatcacgaaaaagaggatgtatttcacttaccccatccttacttcttgggcctcgtgatgaaaagagcttgattaataaattcggaaggaaatgatattttgaacggaaagaccttggcatcgtcagccgtaccgtaggtattatattatactaaatacgtaattaattaagtgactgaaaatatgacgattgaggtgacgcatgttcgtctcatctgttgactgcgaatagccgccggctgtcggcggcgtgcagctgcctgccttcttcctcacttttcatctttcttttggctgcagcatcatcatcgtcgactctataaattaatgtaatggctgtccatctctcctcacattgcttaccttcgttgctccattc

SEQ ID NO: 937 - DNA, 852 bp, Zea mays
  misc_feature (798)..(798): n is a, c, g, or t
caagcggccgtcgccttcccccctcccctcctcaaaaaggcggagaggtggtggtgctcgtgggcacgcagtggagcacccagtacagcagcagcgctgcggcagtggagttaggagcttagcactccccctccgttcccatcccgcgcgcagccgtcggccgagcctgctcagtgcccatcatggtgaggaagaagagaactggccctggcggctctggagaaacttctggagagtcttcaggagcttctggacaaggttcctcacagaggcctgaacggactcaacaacctggggcaggacgtggctgggtgcctcagcagggtggccgtggtggcgggcaacaccagggtcgtggtggacattatcaaggccgtggagggccaggtccacatcaccctggtggactgcctgagtatcaccagcgtgaataccagggacgaggtggtgagtaccagggacagtaccaggggcgtggtggtgcccgttccagaggtggaatttcacagccatactatggtgggcataggggaggtagtgttggacgaaatgttcctccaggtccatccagaacagttcccgagctgcaccaagccccatacgtccagtatcaagccccggtgatttcaccatccccatcgggacctggctcatcctcacagcctatggcagaggtgagctctggacaagtccagcaacagtttgagcaacttgccattcatggtcagagttccatgagtcaagaagttcaagtggcaccagcatcaagcaaatcggttcgattcccattacgccccngcaggggcacttatggggacaggtgcattgtgaaggcgaatcattttttgctga

SEQ ID NO: 938 - DNA, 3799 bp, Zea mays
  misc_feature (928)..(934): n is a, c, g, or t
gccggccgggtcgggaataaccacaagcgaccgtcgccttcccccacctcctcccttcctcaaaaaaaggcggaggcgggagtggtggtggtgctcgtgggcacgcagcggagcaccctgtacagcagcagcgctgcggcagtagagagtgccattggtggagctggtaactagccctcccccctccgttcccgtcccgcgcgcagccgtctgccgagcctgctcagtgcccatcatggtgaggaagaagagaactggccctggtggctctggagaaacttctggagagtcttcaggagcctctggacaaggttcctcacagcagcctgagcgaactcaacaacctgggggaggacgtggctgggtgcctcaacagggtggccatggtggtgggcaacaccagggtcgtgatcgacattatcagggacgtggaggaccagggccacatcaccttggtagtggggcacctgagtatcacccgcgtgaataccagggacgtggtggtgaatatcagggacatggtggtgagtaccagggacggggtggtgactaccagggacgtggtggtggccgctccagaggtggaatgccacagccatactatggtgggcataggggaggtaatgttggacgcaatgttcctccaggtccgtccaggacagttcccgagctgcaccaagccccatatgtccagtatccagccccggtggtttcgccctccccatcgggacctggctcatcctcacagcctatggcagaggtgagctctggacaagtccagcaacagtttcagcaacttgccgatcgtggtcagagttccacgagccaagaaattcaagtggcaccagcatcaagcaaatcggttcgattcccgttacggcccggcaagggcacttatggggacaggtgcattgtgaaggcaaatcannnnnnngctgagcttcctgacaaagaccttcaccaatatgatgtatctataacacctgaggttacttcacgtggcgtcaatcgtgctgtcatgggtgagcttgtaacaatatatagacaatcccatttgggtgggcgtctacctgcatacgatggaagaaagagcctgtatactgctggaccattgccatttacttctatggcatttgaaattaccttgcaagatgaggaagatagtcttggcggtcgccaaggtggacataggcgtgagagagtatttagggtggtgatcaaatttgcagcccgtgctgatctccaccatctggctatgtttctagctggaaggcaagcagatgcccctcaggaagctcttcaagtgcttgacattgtactacgtgaattgcctaccgcgaggtattctcctgtcggtaggtcattttactctcccaacttagggagacgtcaaaaacttggtgagggattggaaagttggcgtggtttttaccaaagcataagggccgacacagatgggcctttcactgaatattgatatgtcctctactgcatttatcgagcctctccctgtgatcgattttgttgctcagcttcttaacagagatatctcagttaggccattgtctgattctgatcgcgtgaagattaaaaaagccctaagaggtgtgaaggttgaggtgactcacaggggaaacatgcgcagaaaatatcgcatttctggcctcacctcacaagcaacaagagagctatcattccctgttgatgatcgtggtactgtgaagactgtggtgcaatacttcatggagacttatggttttagtatccagcacaccactttaccatgcttgcaagtgggtaatcaacaaagaccaaattatctgcctatggaggtttgcaagatagttgaaggacagcgttactcaaagcgactcaatgagaaacaaatcactgctctactgaaagtgacctgccagcgccctcaagagcgcgagctggacatcttacagactgtgcatcacaatgcatactatgaagacccctatgcactggaatttggtataagaattgatgaacgtcttgctgcagttgaagctcgtgttctgccaccaccaagacttaaataccatgatagtggccgagagaaggatgttttgcccagagttggccaatggaacatgatgaataagaaaatggttaatggtggcagagtgagcaactgggcatgtattaacttctctcggaatgtgcaagatagtgccgctaggggtttctctcatgagttggcagtcatgtgccaaatatcaggaatggattttgctcttgagcctgtgctgcctccagtgactgcaaggccagaacatgttgagagagcgttaaaggcacgttatcaagatgcaatgaacatactgaggccacagggaagggaacttgatctgctgatcgtaatactgcctgacaacaatggttctctttatggggatctcaaaaggatctgtgagactgaactcggattggtctcccagtgttgtctgactaaacatgtttttaagatgagcaagcagtaccttgcaaatgttgcactcaaaataaatgttaaggttgggggaaggaatactgtacttttagatgctttgtcaaggagaatcccccttgtcagtgacagaccgaccataatatttggtgctgatgttacccatccacatcctggagaagattccagtccttccattgcagccgttgttgcttcgcaagactggcccgaggtcacgaaatacgctggactagtgagtgcgcaagcccatcgccaggagctgatacaggatcttttcaaagtatggcaggacccgcagagaaggacggtaactggcggcatgataaaggaacttctcatttctttcaagagggcaactggacagaagccccagaggatcatattctacagggatggtgtcagtgagggacagttctatcaagtattgctgtacgaacttgatgccattagaaaggcctgtgcgtccctggagcccaactaccagcctccagttacttttgtcgtggtacagaagcgccatcacactaggctgtttgcgaacaaccacagtgatcagcgcacagtcgatagaagcggaaacatactgcctggcaccgtggtcgattcgaagatttgccatcctactgagtttgacttctacctgtgtagccatgctggcattcagggaacgagccgccctgctcactaccatgtcctgtgggacgagaacaagttcacagctgacgagctgcagaccctgacgaacaacctgtgctacacgtacgctaggtgcacccgctccgtgtccatcgtgcccccggcgtactacgctcatctggcagccttccgagctcgcttctacatggagccagacacctctgacagcgggtcactggccagcggtgcccgtggccccccacccggtgcggcacgcagcagcacgagaggggccgggagtgtcgaggtcaggcccctacctgctctcaaggagaacgtgaagcgtgtcatgttttactgctgagacgctggtgggctgccttcgccaaggaaaatgccctggagcattcccatgtacccgcactgtttcggtgatacagtactatctaacgccgattttgcgcgttaagacttccagtgatctgggaaatttcttgtacgactgttgtagtgttgtgtattcgtaatgtgatgacgcggcagttcttctaggagcttagtgccgtgtaaaatatctgttgtaagttgtaacctgtcaccctctagtgttatgtcatgatgaaccaaattatttgttgtcattcaaaaaaaaaaaaaaaaaaagtacct

SEQ ID NO: 939 - DNA, 1532 bp, Zea mays
aattcggcacgaggctcctcgaaggcgaagcaaagctaccaacgcatacaagagtgagagcagggagcacgagcgctctgagtgagtggaagacgagaggagttggagttccccagggctagggtttcattcgccacccgcgccgcccttcccttccccagcatccgtccgccatggtgaggaagaaaagaactggccctggagagagttctggggagtcttctggagcgcctggtcatggctcctcacagcgtcctcaggcaacacaacagggtgcccgtggtggagggcaacaccaggtgcgtggtggatatctgggccctggagtgccgccttcagagcacccaggtggtgggccgcctgagtatcatcaaccgcttgactaccagggacgtggtggatatcagggccgtggtggaccaccttcacagcatcctggtggtgggacaccccctgggtctcaaccgcgtggctaccaggggcacggtggataccagggccgtggcgggccaccttcacagtatcctggtggtgggacaccccctgggtctcaaccacgtgactaccacggacgtggtggtccgcgtcccagagggggaatgccacagtcataccgtggcgggcatgtgggaggtagtgttgtaccaagtgttccttcaggtccatctaggccagttcccgagctgcaccaagccccagatgtccaacatcaagcccctgtggtggcaacaccatcttcgccaggagctggctcgtcctcgcagcctgggaaggctgaggtgagcgctggacaagtccagcaacagttccagcaacttgcgattcgtaaccaaagcttagccagccaagctggtcagatggcaccagcgtcaagcaaatctgttaggttcccattgcgccctggcaagggtacgcatgggtccaggtgcattgtgaaggcaaatcatttctttgctgagctgcctaataaagaccttcaccaatacgatgtatcaataacacctgaggttacttcacgcggcgtcaatcgtgctgtcatggcagagctagtaaaactttacagacactcccatttggatgggcgtctgcctgcatatgatggaaggaagagtctttatacagctggagcgttgccatttgcttcgaagacattcgaaattactctgcaagatgaggaagacagtcttggtggaggccaaaggcgccagagggtatttcgggtgaccatcaaatttgctgctcgcgctgatctccaccatctggctatgtttcttgctgggaggcagccagatgcccctcaagaggctcttcaagtacttgacatcgtgctacgtgaaatgcctactgccaagtattgtcctgttggtagatcattttattctcccaagttagggagacctcagcaacttggtgaagatatgtcctctactgcattttttgaggccctccctgtaattgattttgtttctcagcttcttaatagagatatctcagttagaccattgtctgattctgatcgcgtgaaggtttga

SEQ ID NO: 940 - DNA, 698 bp, Zea mays
aattcggcacgaggcgggagtggtggtggtgctcgtgggcacgcagcggagcaccctgtacagcagcagcgctgcggcagtagagagtgccattggtggagctggtaactagccctcccccctccgttcccgtcccgcgcgcagccgtctgccgagcctgctcagtgcccatcatggtgaggaagaagagaactggccctggtagctctggagaaacttctggagagtcttcaggagcctctggacaaggttcctcacagcagcctgagcgaactcaacaacctgggggaggacgtggctgggtgcctcaacagggtggccgtagtggtgggcaacaccagggccgtgatcgacattatcagggacgtggaggaccagggccacatcaccttggtagtggggcacctgagtatcgcccgcgtgaataccagggacgtggtggtgaatatcagggacatggtggtgagtaccagggacggggtggtgactaccagggacgtggtggtggccgctccagaggtggaatgccacagccatactatggtgggcataggggaggtaatgttggacacaatgttcctccaggtccatccaggacagttcccgagctgcaccaagccccatatgtccagtatccagccccggtggtttcaccctccccatcgggacctggctcatcctcacagcctatggcagag

SEQ ID NO: 941 - DNA, 1695 bp, Zea mays
gtgacactatagaacaagtttgtacaaaaaagcaggctggtaccggtccggaattcccgggatgtccgagacacttacaataatccttgcccaatcccgtctttagccgctagggttacgcgtccacggcgacgacctctgcgcagagcgtgctgcgattggccggccttcctgggatcctccccgcgcccgacacccggaaacgcgcgcgcgcgcgagggagagacagagtgaggaaacgagggaaggagacgacgcgctcgcctattggccgccggctccgctccttcgcgcccagtgcgacggccacggcctgagcggcgctgccagcaaggcggctagtatgagcagcatggagtcgcggccgggccgaacgaacctggtggagcccatagggcacggcgccgcgctgccgtccggcggccaggcagtgcagccgtggtggacgagctccggggctgtgctcggtgcagtctcgccagccgtcgtggcggtggcgcccgggagcgggacggggattagcctgtcgagcagcccggcaggtggtagtggtggtggcggcgcggctaaaggagccgcgagtgacgagagcagcgaggattcacggagatctggggaaccaaaagatggaagcgctagtcaagaaaagaaccatgccacatcgcagatacccgctctggcgccagagtatttggcaccatactcgcagctggaactgaaccaatcaattgcttctgcagcatatcagtacccagatccttactatgcaggcatggttgctccctatggaagtcatgctgtggctcattttcagctacctggactaactcaatctcgaatgccattacctcttgaagtatccgaggagcctgtttatgtaaatgccaagcagtaccatggtatcttaagacgacggcagtcccgtgctaaggctgaacttgagaaaaaggtggtcaaagccagaaagccataccttcacgagtctcgtcatcagcacgcgatgaggagggcaagaggaaacgggggacgcttcctgaacacaaagaaaagtgacagtggtgctcccaatggaggcgaaaacgccgagcatctccatgtccctcccgacttactacagctacgacagaacgaggcttgaagtagcggtatggctctggcatccttgaacagcagttcctgtccacgggcgtaggcattcgagaccggattcatatagctctccacagcatacgcgcagccatctctgcggtaacgcacgttctcctgaacgagctttgtagcgagataggtatgcaagtgcaatctgggcgcaggaatccatcatcaagtgcccaatgcccatggggtaggtacgctgtttcaggcaattcattcttggctttcacgttccacccttgtgtaactggtgtgttgtaaatgtgtggaaaactaagcttgtgctctgtatcgggccgttcagcggaactgcaaaacgcctgtataattaagatcgaactttggattaactcggtaatgctttgtctggttttcttttagcttttcaactgtaacacggccacagctgattcatgtgatgtgcttgcttatctttccttgtgcaaaaaaaaaaaaaaaaaaaaaaaaaaaaaaaaaaaaaaaaaaaagggcggccgctctagagtatccctcgaggggcccaagcttacgcgtacccag

SEQ ID NO: 942 - DNA, 2096 bp, Zea mays
  misc_feature (962)..(966): n is a, c, g, or t
accatttgctccctctcctcgctacctgtcctcgttcgctgcctgggcgtgccacccctcctcctctagcagtcctctctctccgctcgtgtgctggtccatcgcctgcctcctcggtttatcctgaatccttggaccgacgcacgcacacaagctcagctcagctcagctcaggctgctgctgctggattctttggtgttccatcaggccaaggatcccgcaaagagctccggagccaagcctgctgcagccgtcgcgtcgggtgaggcaggcttcagcttcagtctcctactcgacgaggcaagcggatcggagcgggcctccgctccgccatgatgagcttcaagggccacgaggggtttggccaggtggccgccgccggtgccgggagccaggctgcctcccatggtggagcaggcccgctgccatggtgggcggggccccagctgctgttcggcgagccggcgcccccgtcaccggaggagacgcgccgggacgcccagttccaggtcgtgccgggggttcagggcacgccggatccagcgccgcccaagacagggacacctgaggtcctcaaattctctgtctttcaagggaatttggagtcgggtggtaaaggagagaaaaccccaaagaactctaccactattgctcttcagtcaccgttcccagaatacaatggccgtttcgagattggtcttggtcaatctatgctggccccttccaattatccttgtgctgaccagtgctatggcatgcttgcggcttatggaatgagatccatgtctggtgggagaatgctgttgccactaattgcgccagccgatgcacccgtttatgtgaacccgaaacagtacgaaggcatcctccgtcgtcgccgtgctcgcgctaaggcggagagcgagaacaggctcaccaaaggcagaaaggtgtgagaagactcttcttgtagctgggtgannnnnttgacccttcctacttccatgacagttgacagcgagctaccatcgcaagcagcatttgcgatgctcccatgctttacagtcaccacgttgactggtgatcagtgatcgctgtgtgcctgttcatgctgcagccttatctccatgagtcgcgccacctccacgcgatgcgccgggtgagaggctccggcgggcgcttcctcaacacgaataaaggagggcacggcacggacgttgctgcaaacgggggcagcaagatggcggcggcggcggcaccatcccgtctcgccatgccccctagcgctgagcctccatggctgtcagggctcagcgacggcagcaacccgtgctgccactcccggagtagtgtctccagcttgtccgggtcctacgtggcgagcatctacggtggcttggagcagcacctccgggcgccgcccttcttcaccccgctgccgcccgtcatggacggcgaccacggcggccccacggccgccaccatctcctccttcaagtgggcggccagcgacggctgctgcgagctcctcagggcgtgaaccgaggagggaggggatggctactcagacgaacggccttctccccgatggctggttgtctgtaggcaaatcattcttggctgttctgcattggggtgcgacctacacatcatccgcctaccgtacctaccccacccgtgtccctgaaattccagggtgcttgggttacttacaggggtcttgtgtggtgatgtggctcccccatatgcatttgctgtaacatagcgtacccaaaccactgttgcttggtacttctcgctatcactgcctcatcagtatggattctgcatttctgcgttgtcacagtgtatgaataattgaggcgtcagacttcagggttgctccagttcttggagataggtctgggtttgtttgaagcttgcctggaggtctgaaactttgtgtttggtgaagatgctacgttattgcagtttgaatctgtaagtttgggatcagcattcagttgttgcatcgtctgtgctctggtgccgaggtgttcgttctgaatatttgattcaattcaaaatcttcagctaaaaaaaaaaaaaaaaacgagacgctcgaggtacccaatcg

SEQ ID NO: 943 - DNA, 1149 bp, Zea mays
gctcattttcagctacctggactaactcaatctcgaatgccattacctcttgaagtatccgaggagcctgtttatgtaaatgccaagcagtaccatggtatcttaagacgacggcagtcccgtgctaaggctgaacttgagaaaaaggtggtcaaagccagaaagccataccttcacgagtctcgtcatcagcacgcgatgaggagggcaagaggaaacgggggacgcttcctgaacacaaagaaaagtgacagtggtgctcccaatggtaaggctgaacctgagaaagctagtacaattgttgcataatctcttcatactgcacttgatatgagtgcacgcatttctgtttctttataccctgctcccgcatgccctaggaggcgaaaacgccgagcatctccatgtccctcccgacttactacagctacgacagaacgaggcttgaagtagcggtatggctctggcatccttgaacagcagttcctgtccacgggcgtaggcattcgagaccggattcatatagctctccacagcatacgcgcagccatctctgcggtaacgcacgttctcctgaacgagctttgtagcgagataggtatgcaagtgcgatctgggcgcaggagtccatcatcaagtgcccaatgcccatggggtaggtacgctgtttcaggcaattcattcttggctttcacgttccacccttgtgtaactggtgtgttgtaaatgtgtggaaaactaagcttgtgctctgtatcgggccgttcagcggaactgcaaaacgcctgtataattaagatcgaactttggattaactcggtaatgctttgtctggttttcttttagcttttcaactgtaacacggccccagctgattcatgtgatgtgcttgcatatctttccttgtgccaatttttgttcgggggacgcagtaattttatattttttattttcgggagtccccccaatcgtgtaaggttcctgggaaccagttgggactttaattgaaccccccgaattcatatgaaaatcctacaaagtttttgggaaaaaaaaaaaaaaaaaaaaaaaaaaaaaaaaaaaaaaaaaaaaaaaaaaaagggcggccgctctagagtatccctcgaggggcccaagcttacgcgtacc

SEQ ID NO: 944 - DNA, 1215 bp, Zea mays
aggccctcctctgtctgtgtgcgagcccaagagaaagggagtcagagagagagagagacgtggaggagaccttgcagaggagcgaagcaagcaaggtgggaaagaggcagcagcaagggcggcgggctgccggaaggggaacatgctccctcctcatctcacagagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttctacgcaccttttcaggccatatcatacccatatgccgatccatactacggtggcgcggtggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtagggagccccgacactggcaactcatccttggcttatcagcgattcgactcggctctccctcgtctgaaactgaactctctgcaactactgtaactgtaactaaactgggtgtgcccggattggcggtcgttctgttctactactagtacctgctacgcgtcgttgggttgggtctggactagagagcgtgctggttctttgatgaacttggctggacttgagggtgttgactagcgcgaagctgagttccatgtaaaacttttgcttcaagaccgatgactggcggcataataagtagcagtaataacc

SEQ ID NO: 945 - DNA, 2291 bp, Zea mays
aaagcaggctggtaccggtccggaattcccgggatgtgcgagcgcaagagaaagggagtcagagagagagagagagggaggagaccttgcagaggagcgaagcaagcaaggtgggaaagaggcagcagcaagggcggcgggctgccggaaggggaacatgctccctcctcatctcacaggtcttccttcctgctcgctgacttgcctctctccaccctctctgatctgagctctacggctcttcctttccctgcggtgataccggagctctctgctcccacctcccagtaccagccgacctgtttttttttcgtttgtttgggggtgggtggatgtgggggagggatcgtttctcggttcttctggacgatttgtggtggatctggctggttccttggttgctcggctggtcttttgagttgatacggtgctgggatttgtaggcgcatttctgggtggaggtggccggtggggtaatggctccagcatgtgatccttgctaaggccttacagttacagcacactgcatgccggatttgtgttgctttatttatgttcctgcccgtgtatctaatcgttttgaactcaaggggagaactagtgacctactgatgagattaagatgcagcactgtttttgctagcgggaggcctatctgcagaactaactagtcatgtctgaggccctcagcacatatactctggttgcatgaaggattcttagaattcagagggcgctaccgagttgatgcatggtactgatacagcgctagcgctagcgctagctagcttactactagtacctttagagcatgtgcatgcccaagttacacatctcgcctcgcgtgatcaattgagggcctactagcttactactgctgccttagtttcctttttcatgaatacagttacggtgggaaggtcaaattctgttgtgtattcatgcatcagctgtgctccttaaggcttgcagaccttaatacccagtacgtgtttcgaatctcgtatgtttatttctgggaactgacctgtgtttatatatgtttggacagtacgaactgaaaaacaagagtaaagaatttccgtgagatgagacagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggctgaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgattagggagccccgacactggcaactcatccttggcttatcagcgattcgactcggctctcgctcgtctgaaactgaactctctgcaactactgtaactgtaactaaactgggtgtgcccggattggcggtcgttctgttctactactactagtaccttagtacctgctacgcgtcgttgggtctggactagagagccgtgctggttctttgatgaacttggctggacttgaggtgttgactagcgcgaaactgagttccatgtaaacttttgcttcaagaccgatgactggcggcataataagtagcagtaataaccattcttccaaaaaaaaaaaaaaaaaagtcatcggtgctggttttttgatgaacttggctggacttgagggtgttgactagcgggaagctgagttccatgtaaaatttttgtttcaagaccgatgacggggggcataataagtagcagtaataccc

SEQ ID NO: 946 - DNA, 1588 bp, Zea mays
gacactatagaacaagtttgtacaaaaaagcaggctggtaccggtccggaattcccgggatcatgcccaagttacacatctcacctcgcgtgatcaattgagggcctactagcttactactgctgccttagtttcctttttcatgaatacagttacggtgggaaggtcaaattctgttgtgtattcatgcatcagctgtgctccttaaggcttgcagaccttaatacccagtacgtgtttcgaatctcgtatgtttatttctgggaactgacctgtgtttatatatgtttggacagtacgaactgaaaaacaagagtaaagaatttccgtgagatgagacgtacgtaaggataatccccaagacattgctcaatctgtttctctctctctctctctcttttcggcgagcagtttgtcctttttctttcaatttcttttactactacacccgttatcgaatatttgtcatccgctggctcatttataaactaaaacacgataaataaagaaggaaagaacggagagagtagtagtggtttagtttcatgcagctagaattctaacgccctcctggatccttgtgcagagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgcccctgccgatcgagccagccgccgaagagcccatctatgtcaacgcgaagcagtaccacgctattctccggaggagacagctccgtgcaaagctagaggctgaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtagggagccccgacactggcaactcatccttggcttatcagcgattcgactcggctctcgctcgtctgaaactgaactctctgcaactactgtaactgtaactaaactgggtgtgcccggattggcggtcgttctgttctactactagtacctgagtacctgctacgcgtcgttgctggttctttgatgaacttggctggacttgaggtgttgactagcgcgaagctgagttccatgtaaacttttgcttcaagaccgatgactggcggcataataa

SEQ ID NO: 947 - DNA, 1723 bp, Zea mays
ccgcttcaaatcttttcgccctttccctgcaccggctggggctcgatcagcgtcagttaccacgacgaccgatcttgctcgccagcgagagcgacccctcccctccctacttcccatgctgatctcggcgcgcttctcttcctcctcccccagagccgggcactgatttcccttggctgctgctgctggattctttggtgttccatcaggccaaggatcccgcaaagagctccggagccaagcctgctgcagccgtcgcgtcgggtgaggcaggcttcagcttcagtctcctactcgacgaggcaagcggatcggagcgggcctccgctccgccatgatgagcttcaagggccacgaggggtttggccaggtggccgccgccggtgccgggagccaggctgcctcccatggtggagcaggcccgctgccatggtgggcggggccccagctgctgttcggcgagccggcgcccccgtcaccggaggagacgcgccgggacgcccagttccaggtcgtgccgggggttcagggcacgccggatccagcgccgcccaagacagggacacctgaggtcctcaaattctctgtctttcaagggaatttggagtcgggtggtaaaggagagaaaaccccaaagaactctaccactattgctcttcagtcaccgttcccagaatacaatggccgtttcgagattggtcttggtcaatctatgctggccccttccaattatccttgtgctgaccagtgctatggcatgcttgcggcttatggaatgagatcgatgtctggtgggagaatgctgttgccactaaatgcgacagctgatgcacccatctatgtgaatccgaagcagtacgaaggcatcctccgccgtcgccgtgctcgcgccaaggcggagagcgagaacaggctcgccaaaggcagaaagccctatctccacgagtcgcgccacctccacgcgatgcgtcgggtaagaggcaccggcgggcgcttcctcaacacgaagaaaggagggcgcggcacgggcgttgctgcaaacgggggcagcaagatggcggcggcggcggcaccatcccgtctcgccatgccccctagcgctgagcctccatggctgtcagggttcagcgacggcagcaacccgtgctgccactcccggagtagtgtctccagcttgtccgggtcctacgtggcgagcatctacggtggcttggagcagcacctccgggcgccgccctttttcaccccgctgccgcccgtcatggacggcgaccacggcggccccacggccgccaccatctcctccttcaagtgggcggccagcgacggctgctgcgagctcctcagggcgtgaaccgaggagggaggggatggctattcagacgaacggccttctccccgatggctggttgtctgtaggcaaatcatttttggctgttttgcattggggtgcgacctacacatcatccgcctaccgtacctaccccacccgtgtccctgaaattccagggtgcttgggttacttacaggggtcttgtgtggtgatgtggctcccccatatgcatttgctgtaacatagcgtacccaaaccactgttgcttggtacttctcgctatcactgcctcatcagtatggattctgcaaaaaaaaaaaaaaaaaaaaaaaaaaaaaaaagggcggccgctctagagtatccctcgaggggcccaagcttacgcgtacc

SEQ ID NO: 948 - DNA, 1871 bp, Zea mays
attttatacgcgcctcccccgtcccgtctcgtcccctctctctctctccctctcgcgtctcgtcttggccactcaccccacccgccccctctctctttctctctctctgccacagtgcactgctcagtcggcagtcgcagcgctgcggctgtggttcttcttgtcctgttccgccgcccgcccgcccgctgctactgctgggatagtgaaacctggtgcctggtggttcggttaggtgcttccctcgtcaacgtcagacgcccccacttccgccagcaacaacaccagcagcagcacgatgatgagcttcaggagcagcagccacgagggcttcggcttcggccacgccgccgccgcggccagcggagcgccgctgccgtggtgggcagggccggccccgatgctgagcggcgagccgctggccctgtcgccggaggcccactgccgggacggccgcatccaggccccccagggacctcccgtgccgtcggtcaaggctcctgtactggcaccccagcagccgcctccgctgccggagagggggatccctgagctcctcaacctctccgtggatcctcaaggtaaagggaagaaaggatctgatcactctgccactattgctttgcaatcaccatttgcaatatacaatgctcattttgagctgggccttggtcaatcaatgatttccgctgataattcttatgctgatcaacactatggcctgctttctccttatccagtgggtgcaacgcctggaggtcgtctgcttataccactgaataggccaacagaagcaccaatttatgtgaacgctaagcaatatgacgccatcatgcgtcggcgctgtgcccgtgccaaagcagagagggaaaataggctggtcaaaggcaggaagccatatctccatgagtcacgccatcagcatgcactgcgtcgcccgcgaggctctggcggacgcttcctgaacacaaagaaagaatccagcgggaaggatgctggtggtggcagcaaggcaatgttcagcaaccccctcatgcgccaggtggcgtctccaagctcagagatccagcagtcagacctgggcaacccgagcagcgtgtccagcctgtcgggttcagaggtgtcaagcatgtacgaccatgaagacgcgggtcactgccacggcttggatcaccccttcttcacccggctcccgagcatcatggacggcggcgagcacggggtcatcgtctgcaaccccttcaagtgggcagcggcctctgaagtctgctgcgacctcctgaaagcatgactagaggggttaccggacggccaaacgctaggagctggtgactgctggcggtttccagctccgggtcaggggttgtccctccctccgtttggctcccggtaggcaaatcattcttggctgaaggcaacgtgagcgttccactcgtcccacctatttctcctggaaactctggctcctagtttctgggatcttgtggtgagtgcaacatcccttgcctaaaaaaacaaaaaaaaatcactagttgattgtactatctaccaacttctaaatggtttcaccttagctttctgaataataaagcctgaaacttcggactcgtctgaagtttcagaggtactggagttctgctatgtatggattctgttaagcgtcaagactaaggttctgttggtgatgaattgtagtgtgattggagcttgggtggtcttgattcctactttgtaatgtgctgaaagcttgtgctagagtaatgtattggaactggagcttggtttgtaaaaaaaaaaaaaaaagctatcgatacgtcaacctcagggggggcccggacaaatttcgccatagggagcgaattaccccccta

SEQ ID NO: 949 - DNA, 1529 bp, Zea mays
gaacaagtttgtacaaaaaagcaggctggtaccggtccggaattcccgggatcgcgtccacggcgacgacctctgcgcagagcgtgctgcgattggccggccttcctgggatcctccccgcgcccgacacccggaaacgcgcgcgcgcgcgagggagagacagagtgaggaaacgagggaaggagacgacgcgctcgcctattggccgccggctccgctccttcgcgcccagtgcgacggccacggcctgagcggcgctgccagcaaggcggctagtatgagcagcatggagtcgcggccgggccgaacgaacctggtggagcccatagggcacggcgccgcgctgccgtccggcggccaggcagtgcagccgtggtggacgagctccggggctgtgctcggtgcagtctcgccagccgtcgtggcggtggcgcccgggagcgggacggggattagcctgtcgagcagcccggcaggtggtagtggtggtggcggcgcggctaaaggagccgcgagtgacgagagcagcgaggattcacggagatctggggaaccaaaagatggaagcgctattcaagaaaagaaccatgccacatcgcagatacccgctctggcgccagagtatttggcaccatactcgcagctggaactgaaccaatcaattgcttctgcagcatatcagtacccagatccttactatgcaggcatggttgctccctatggaagtcatgctgtggctcattttcagctacctggactaactcaatctcgaatgccattacctcttgaagtatccgaggagccggtttatgtaaatgccaagcagtaccatggtatcttaagacgacggcagtcccgtgctaaggctgaacttgagaaaaaggtggtcaaagccagaaagccataccttcacgagtctcgtcatcagcacgcgatgaggagggcaagaggaaacgggggacgcttcctgaacacaaagaaaagtgacagtggtgctcccaatggcgaaaacgccgagcatctccatgtccctcccgacttactacagctacgacagaacgaggcttgaagtagcggtatggttttggcatccttgaacagcagttcctgtccccgggcgtaggcattcgagaccggattcatatagctctccccagcatacgcgcagccatttttgcggtaacgcacgttttcctgaacgagctttgtagcgagataggtatgcaagtgcaatctgggcgcaggaatccatcatcaagtgcccaatgcccatggggtgggtacgctgtttcaggcaattcatttttggctttcacgttccccccttgtgtaactggtgtgttgtaaatgtggggaaaactaagcttgtgctttgtatcgggccgttcagcggaactgcaaaacccctgtataattaagatcgaactttggattaactcggtaaaaaaaaaaaaaaaaaaaaaaaaaaaaaaaaaaaaagggcggccgctctagagtatccctcgaggggccccaagcttacgcgtacc

SEQ ID NO: 950 - DNA, 582 bp, Zea mays
agaaagccataccttcacgagtctcgtcatcagcacgcgatgaggagggcaagaggaaacgggggacgcttcctgaacacaaagaaaagtgacagtggtgctcccaatggaggcgaaaacgccgagcatctccatgtccctcccgacttactacagctacgacagaacgaggcttgaagtagcggtatggctctggcatccttgaacagcagttcctgtccacgggcgtaggcattcgagaccggattcatatagctctccacagcatacgcgcagccatctctgcggtaacgcacgttctcctgaacgagctttgtagcgagataggtatgcaagtgcaatctgggcgcaggaatccatcatcaagtgcccaatgcccatggggtaggtacgctgtttcaggcaattcattcttggctttcacgttccacccttgtgtaactggtgtgttgtaaatgtgtggaaaactaagcttgtgctctgtatcgggccgttcagcggaactgcaaaacgcctgtataattaagatcgaactttggattaactcggtaatgctttgtctggttttcttttagcttttca

SEQ ID NO: 951 - DNA, 766 bp, Zea mays
acccatatgccgatccatactacgggggcgcgggggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtagggagccccgacactggcaactcatccttggcttatcagcgattcgactcggctctccctcgtctgaaactgaactctctgcaactactgtaactgtaactaaactgggtgtgcccggattggcggtcgttctgttctactactagtacctgctacgcgtcgttgggttgggtctggactagagagcgtgctggttctttgatgaacttggctggacttgagggtgttgactagcgcgaagctgagttccatgtaaaacttttgcttcaagaccgatgactggcggcataataagtagcagtaataacc

SEQ ID NO: 952 - DNA, 1791 bp, Zea mays
atgggggtcggcggcggcgacagctgggacgccatgctcggcaatgccgctgcggcggggcaggaccagacgttcttgaactggatcattggggccgccggcgacctggatcagccagggccgccgcttcccgtgcaccagcagccgctccttgacaatgtgggcttcgggttcccggcagcggacccccttggtttcacgctcgatccacacctctgcggccttgcctgtgacatgtcgtcccctggtgcggtgtcgcacactaccaacagtagcggcggtggcaacaaggcgtcctcggccttcggcctcttctcaccggagtctgcttccctccagccgccgccgcccccggtgctgttccacgaaggtatcgacacaaagccccctcttcttggtgcgcagctgcccggcctcctccaccagtaccagcaccagccgacccccggcacaaccttcttcatgcccatcccctccttccccgaccccaatcagcgctcgccactcatccaaccaccgcccaaacgtcctcaatccataggggatgacctctatctcgcccgaaaccggcttctgccgccgccggcggggcaaggtcatgcctttccaccattaaatggcccttctccgttccagctccagccttcgccaccgctgtcccacggggcgatgaagacaacggctgcggaggcggcgcagcagcagttgctggacgagctggcggcggcggcaaaggccgccgaagctggcaattccattggcgcgcgagagatattggcgcggctcaatcaccagcttcccttgctcgggaagccgttcctccgctccgcctcctacctcaaggaggccctcctcctcgcgctcgccgaaggccaccacggcggctgccacctcacgtcgcccctcgacgttgccctcaagctcgcggcgtacaagactttctctgaccactcgcccgtgctccagttcaccaacttcaccgcgacacaggcacttatcgacgaaattgcccgcagcacatcgtcctgcatccatgtcatcgattttgatcttggtgttggaggccagtgggcttctttcttgcaggagctcgcacaccgccgtggcgcaggcggtgcggctctgccgtccgtgaagctcactgcctttgtatcagctgcttcccaccatccactggagctgcgtctcacgcgtgacaacattgcacagtttgctgcagaccttgggattccctttcagttcagtgctatcagcgctgatacgatcaaccctgcagagctcgtttctgccaccgctgatgaagttgtagctgttgtcctcccggttggttgctctgctcgtgcaccaccgctgccagcgatccttcggttggtgaaacagctggctcctaagattgtgatagccatagaccatggcgctgatcgtgctgaccttcccttctcgcagcacttcttgaattgcttccagtcctgcatgttcctccttgattcgcttgatgctgctggcattgatgctgattctacctgcaagattgagaagttcctgattcagccaagaattgaggatgcggtgcttgggcggggcaaggtggacaagccaattgcatggagaagtgcatttgcagctgctgggttcgcacctgttccacccagcaatttggcggaggcacaggccgactgcctcctgaagcgggtgcaggtccgcggtttccacgtggagaaatgcggggtcgggctcacactatactggcagtgtggcgagcttgtcactgtatcagcatggcggtgctga

SEQ ID NO: 953 - DNA, 1916 bp, Zea mays
aagaaagaaagggaaggcggggggaggccggccaaggcaccaccacaccaccacccgacgaattcaagcatgaggccgccgccgccgccggcggccacgaccatgcgtttccacgacggtgccgacataaagcccccgcttctgggagtcccgtcggcaggtctacttcatcaacaccagacgctgccggcggcctccttcttcatgccgctcccctccttccccgaccatcagcaccagccacatctcccgcccccgccgaagcgccaccactctatgcccgacaacctgttcctcctccaaaaccagctccagccgccgccgtcgcagggtctaccattcccgccactgcataccaccacgcccttccagctccagccaccactgcaaccgccgcggggagcgatgaaaacaaccccggcggcgcagcaacatcaacagcttcaggatgagcttgcggcagaggcaaaagcggctgaggtcggcaactccatcagcgggcgcgagatattggtgcggctcaatcagcagcttcccccaatctggaagcctttcctccgctccgcttcctacctcaaggaggccctcctcctcgcgctcaccgacggccaccgaggctccactcacctatcctcccctctcgacgtcgccctcaagctcggtgcatacaagtccttctccgacctctcgcctgtgctccagttcgccaatttcacgaccacccaggcgctcctcgatgagatcacctcaacaacttcatcttgtatccacattattgatttcgaccttggtgttggcggccagtggacttccttcttgcaggatcttgcacactgccgtggaactgggaacgccccctgccaatgttgaagctcacagtcttcgtctcaagtgcttcccacaatccccttgagctgcatcttactcgggagaacctcacgcaatttgttgtggaccttggcattccatttgagttcactaacatcaatcttgatgtgtttgatcccacagaactcattgctcctagcccaatgaggttgtggttgtttgcctccctgttggttgctctgcacgcacgccaccgctccctatgttgcttcagttggtgaaacagcttgcgcctaagattgttgtggctattgaccatggcagttaccggggtgacctcccattttcacaacacttcatgaattgcttccagtcttgtatgttccttctcgactcacttgatgctgctggcaccaacgtggatgctgccagtaggattgagaggtttctgatccaaccgagagtagaggatgcagtacttggccgatggaaagctgaaaaagcaatggcttggtgggcagtgtttacatcggccgggtttgctccggtaccgctcaacaacctcgcagaagcacaagctgactgcctgttgaagcgcgtgcaggtctgaggattccatgtggagaagtgtggaatgggtctagcactctactggcagagtagcgagctcgtgtctgtctcggtatggtggtcctgatcatacggactccatccatcaaccatcatgacacctacaccaatttgcaggcatgtttagccctggtaatgtgcattttgtcttgcaatttcaaacatcgcgaagaaaactattgtattggttgttccacgcctctgattgctttgctgatgttggagtactgcataggcctaatgaatttagccagtatggtgtgggaatctctacaatgtaacatgttggtctcttaactctgttcttgctctcttcttggttagccagaggacaatttggcaaatctgtggcaatgatgttgttattttactaggtaattcagatgaaaactgaaatggactgaaatggttgggtatattaactttcttggcttcatattccaaaaaaaaaaaaaaaa

SEQ ID NO: 954 - DNA, 2207 bp, Zea mays
atgggggtcggcggcggcgacagctgggacgccatgctcggcaatgccgctgcggcggggcaggaccagacgttcttgaactggatcattggggccgccggcgacctggatcagccagggccgccgcttcccgtgcaccagcagccgctccttgacaatgtgggcttcgggttcccggcagcggacccccttggtttcacgctcgatccacacctctgcggccttgcctgtgacatgtcgtcccctggtgcggtgtcgcacactaccaacagtagcggcggtggcaacaaggcgtcctcggccttcggcctcttctcaccggagtctgcttccctccagccgccgccgcccccggtgctgttccacgaaggtatcgacacaaagccccctcttcttggtgcgcagctgcccggcctcctccaccagtaccagcaccagccgacccccggcacaaccttcttcatgcccatcccctccttccccgaccccaatcagcgctcgccactcatccaaccaccgcccaaacgtcctcaatccataggggatgacctctatctcgcccgaaaccggcttctgccgccgccggcggggcaaggtcatgcctttccaccattaaatggcccttctccgttccagctccagccttcgccaccgctgtcccacggggcgatgaagacaacggctgcggaggcggcgcagcagcagttgctggacgagctggcggcggcggcaaaggccgccgaagctggcaattccattggcgcgcgagagatattggcgcggctcaatcaccagcttcccttgctcgggaagccgttcctccgctccgcctcctacctcaaggaggccctcctcctcgcgctcgccgaaggccaccacggcggctgccacctcacgtcgcccctcgacgttgccctcaagctcgcggcgtacaagactttctctgaccactcgcccgtgctccagttcaccaacttcaccgcgacacaggcacttatcgacgaaattgcccgcagcacatcgtcctgcatccatgtcatcgattttgatcttggtgttggaggccagtgggcttctttcttgcaggagctcgcacaccgccgtggcgcaggcggtgcggctctgccgtccgtgaagctcactgcctttgtatcagctgcttcccaccatccactggagctgcgtctcacgcgtgacaacattgcacagtttgctgcagaccttgggattccctttcagttcagtgctatcagcgctgatacgatcaaccctgcagagctcgtttctgccaccgctgatgaagttgtagctgttgtcctcccggttggttgctctgctcgtgcaccaccgctgccagcgatccttcggttggtgaaacagctggctcctaagattgtgatagccatagaccatggcgctgatcgtgctgaccttcccttctcgcagcacttcttgaattgcttccagtcctgcatgttcctccttgattcgcttgatgctgctggcattgatgctgattctacctgcaagattgagaagttcctgattcagccaagaattgaggatgcggtgcttgggcggggcaaggtggacaagccaattgcatggagaagtgcatttgcagctgctgggttcgcacctgttccacccagcaatttggcggaggcacaggccgactgcctcctgaagcgggtgcaggtccgcggtttccacgtggagaaatgcggggtcgggctcacactatactggcagtgtggcgagcttgtcactgtatcagcatggcggtgctgatcagcgatccacgcctgtgcgcaccatgttccaccaacatttgctggcatcttcaacccgagtaatgtgtattttgtcttgcaattaaatgctactaaggaaactgatatattgctgttgaaccctccatgttcatcatctttgcaacttacgagctagaactagtggatttttagcaatgttggtgccaatatctctagtgtaatgatgttggcctaagattttaccctgcttgctctcagctcactagacattcccatgtcatttggaacactgcttgtgaggagaggttataattaacctatcaaatgtctgtggtatagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 955 - DNA, 2752 bp, Zea mays
gcacaccgctcctcctcgctgttctacgcccacccgcacaagcaatcgtcgcatcgccaccaccaccaccgagaagcagccgcctcgcgccccagatctcgccggcaggggtcgcacgccctagcatgcgcgagtaagtacatgagggcggcgcccttcagtgccgacgggaaaggggcggggaccatagaggcgctgctttggccgaacgggaagggcggcggcggaggggacctgctgttggagccgacgtcggtgctggactgtagacggagcccgagcccgcggtactcgtcatcgacgctgtcttcgtccctgggtggcgccgcgggagactcctcttccggcgtggcggcggtttcggagaacagcgccgccgccgccgccgaagccaccaaatgggcggcgccaggcgagcaccgcggcggcggcgaaggaggcggaggcggaggaagcaggaaggagtggtccggcggtgagctgccgcccataccggggaccctggacatcggattcggcgcggaggagggctgggatgccatgctcggcgacgccgcggcggtggtcgggcaggaccagacattcctcaactggatcatgaccgcgccgggcgacatggaaccgccggcgctggcgctcctcggtaatgccgccggcttcgagttcccggcctcggacccgatcgggttctccctgcagcatcaccccaccggcggcggcacctcggttggggcgctggcctccgacctatcgtcccccagcgcgaggtcgctcaccagcagcagcggcagcagcagtaaggccacttccactttcggcctcctacgaaccgaggcagtttttcagccgccgccgccggccacgaccatgcctttccacgacggtgccgacataaagcccgctcaccttggagtcccgtcggcaagtctactcctcaatcaacaccaagcgttgtcagcagcctccttcatgccgctcccctccttccctgaccatcagcaccagccacatctcccgcccccgccgaagcgccaccactctatgcccgacaacctgttcctcctccaaaaccagctccagccgccgccgccgccgtcgcagggtctacgattcccgccactgcataccaccgcgcccttccagctccagccaccactgcaaccgccgcggggagcgatgaaaacaaccccggcggcgcagcaacatcaacagctcctggacgagcttgctgcggcggcaatggcggctgaggtcggcaactccatcggcgcgcgagagatattggcgcggctcaatcagcagcttcccccaatcgggaagcctttactccgctccgcttcctacctcagggaggccctcctcctcgcgctcaccgacggccaccaaggctccactcgcctaacctccccgctcgacgtcgccctcaagctcggtgcatacaagtctttctccgacctctcgcctgtgctccagttcgccaattttacggccacacaggcgcttcttgacgagatcgcctcaacaacttcgtcttgtatccgcatcattgatttcgaccttggtgttggcggccagtgggcttccttcttgcaggagctcgcataccgccgtggaactgggaacggtcccctgccaatgttgaagctcacagccttcgtgtcaagtgcttcccaccacccgcttgagctgcatcttactcgggagaacctgtcgcaatttgctgtggaccttggcattccatttgagttcactgccatcaatctcgatgcgtttgatcccgcagagctcattgctcctagcgccgatgaggttgtcgctgtttgcctccccgttggttgctctgcacgcacgccaccgctcccgatgttgcttcagttggtgaaacagcttgctcctaagattgttgtggctattgaccacggcagtgaccggggtgacctcccgttttcgcagcacttcatgaattgcttccagtcctgtatgttccttctcgactcactcgatgctgctggcaccaatgcggatgctgccagtaagatcgagaggtttctgatccaaccgagagtagaggatgcagtgcttggccgtcggaaggctgaaaaggcaatggcttggcgggcagtttttacatcggctgggtttgctccagtgccactcagcaaccttgcagaggcacaagctgactgcctcttgaagcgggtgcaggtccgaggattccatgtggagaagtgtggaatgggtctagcactgtactggcagcggggcgagctcgtgtctgtctcggcgtggcggtgctgatcatagcaacctcatccgtcaaccatcgtcgtcgtcgcgcctacactattcgcaggcatgtttaactccggtaatatgcgttttatcttgcaaacattgcaaagaaactattgtcatggttgttccacgcctctgattgctttactgctgtttttggagtattagctaggcctaatgaatgttgcaatcttggtgtgggtgtccccctacaatgtaacatgttggtactagggtctcaacgctgttcgtgctctcttcttggttagccggaggctactttggcgtatttgtggcaatggtgttcgttattttactaggtaaatcagatgaagactgacatatgaactgaaatggttgggcattttttttcaaaaaaaaaaaaaaaaaaaaaaaaaaaaaaagggcggccgctctagagtatccctcgaggggcccaagcttacgcgtacccagc

SEQ ID NO: 956 - DNA, 536 bp, Zea mays
cctgcaagaaagaagcccactggcctccaacgccaagatcaaaatcgatgacatggatacaggacgacgtgctgccaccaatttcgtcaagaagtgcctgcgttgcggtgaagttggtgaactggagcacgagcgagtggtcaaagaaagtcttgtacgccgcgatgatggcagccgccgtgatggccttcggcgagcgcgaggagggcctccttgaggtaggaggcggagcggaggaacggcttcccgagcgggggaagctggtgattgagccgcgccaatatcgctcgcacgccaatggaattgccagcttcagcggcctttgccgccgccgccagctcgtccagcaactgctgctgcgccgcctccgcagccgtcctcttcatcgccccgtggggcagtggcggcgaaggctggagctggaatggagcaggaccatttagtggtggaaaggcatgaccttgccccgtcggcggcggcggcagaagccgagttcgggctggtggtgcacgggaagcggcggtcctgactgatcc

SEQ ID NO: 957 - DNA, 2623 bp, Zea mays
gcggaacggggctgcggaccccatcggaggcggaaagacgctgttctggccggaggggaaggcgaagacgctgttggagccgtggtccgtgctggactgcacgcggagccccagcaactcaacgtcgacgctgtcgtcgtccctgggcagcggcgctgaggactcgaccggcgtggcggtggtttcggacagaagcgccgccgccgaagccaccaaatggggagcccccggcgagcacggcggcggcggcgggaaggaggactgggccggcggctgtgagctgccgccgattcccaccggcctcgacatgggggtcgtggtcgccgacagctgggacgccatgctcggcaacgccgctgcggcggcgcaggaccagacgttcttgaactggttcattggggccgccggcgacttggatcagtcaggaccgccgcttcccgtgcaccaccagccgctcctcgacaatgtgggcttcgggttcccggcagcggaccctctgggtttcacgctcgatccccacctcggcggcgttgcctctgacatgtcgtcccctggtgcggtgtcgcaaactaccaacagtggcggcggtggcaacaaggcgtcctcggccttcggcctcttatccccggagtctgcttccttccattcgccgccgcttccggtgctgttccatgaaggcatcgacacaaagccccctcttgatacgcagtcgcccggcctcctccaccagtaccagcaccagccgagccccgccacaaccttcctcatgtccatcccctccttccccagctacaatcagcagtcgccactcatccaaccaccgcccaaacgtcatcaatccataggaggcgacctctatctcgcccgaactcggcttctgccgccgccgccgacggggcaaggtcatgcctttccaccactaaatggtcctgctccattccagctccagccttcgccgccactgccccacggggcgatgaagaggacggctgcggaggcggcgcagcagcagttgctggacgagctggcggcggcggcaaaggccgccgaagctggcaattccattggcgcgcgagagatattggcgcggctcaatcaccagcttcccttgctcgggaagccgttcctccgctccgcctcctacctcaaggaggccctcctcctcgcgctcgccgaaggccaccacggcggctgccacctcacatcgcccctcgacgttgccctcaagctcgcggcgtacaagactttctctgaccactcgcccgtgctccagttcaccaacttcaccgcgacacaggcacttatcgacgaaattgcccgcagcacatcgtcctgcatccatgtcatcgattttgatcttggtgttggaggccagtgggcttctttcttgcaggagctcgcacactgccgtggcgcaggcggtgcggctctgccgtccgtgaagctcactgcctttgtatcagctgcttcccaccatccactggagctgcgtctcacgcgtgacaacattgcacagtttgctgcagaccttgggattccctttgagttcagtgctatcagcgctgatacgatcaaccctgcagagctcgtttctgccaccgctgatgaagttgtagctgttgtcctcccggttggttgctctgctcgtgcaccaccgctgccagcgatccttcggttggtgaaacagctggctcctaagattgtgatagccatagaccatggcgctgatcgtgctgaccttcccttctcgcagcacttcttgaattgcttccagtcctgcatgttcctccttgattcgcttgatgctgctggcattgatgctgattctacctgcaagattgagaagttcctgattcagccaagaattgaggatgcggtgcttgggcggggcaaggtggacaagccaattgcatggagaagtgcatttgcagctgctgggttcgcacctgttccacccagcaatttggcggaggcacaggccgactgcctcctgaagcgggtgcaggtccgcggtttccacgtggagaaatgcggggtcgggctcacactatactggcagtgtggcgagcttgtcactgtatcagcatggcggtgctgatcagcgatccacgcctgtgcgcaccatgttccaccaacatttgctggcatcttcaaccccagtaatgtgtattttgtcttgcaattaaatgctgctaaggaaactgatatattgctgttgaaccctccatgttcatcatctttgcaacttacgagctagaactagcggatttttagcaatgttggtgccaatgtctctagtgtaatgatgttggtctaggtttttaccctgcttgctctcgggtcactagacattctcatgtgacttgaaacactgcttgtgaggagagggtataattaacctatcaaatgtctgtggtacagtattaatacgtgtttcatgttcttttatatcagttattgttcttatggtttttcattgtgcagttcaattgttttgggtcaaacatcaatatgttttgttcccttaaaaaaaaaaaaaaaaaaaaaaaaaaaaaaaaaaaaaaaaaaaaaaaaaagggcggccgctctagagtatccctcgaggggccctaagcttacgcgt

SEQ ID NO: 958 - DNA, 2010 bp, Zea mays
gcacgagaccattacctagaacatcctaatcaaaaaaataccaacagcaacaccatgacctccgaatccgatcccccacacgcccacaccaccttggtggtgggtcttggttcatgctgcccactccggcactcctcttctcatgacaagcgcgctgccgcacatgtctgagctcccggacggcggcgccggcggaaatggccaagacgaagccgccgccttcgcctcgccggccaagcgcctccgtaggtcgccggcgctcgagcccacctccgtgctctacaaccgcagcccgagcccgcccacatcctcctccctggtctcctccgccgcgcccgagccgccccccatcagcgccgaggattgggaggccgtcctctccggcggcgacatggccgcgccaccagccgccgcgcggtctcaagacgcctctttcctccgctggatcatggacgccgacgcccaagtcgacgccttcgatcccttcctgccttgccaagagaccgccgtcgtcgagcccttcttgcagccgcagctcccgctccccgtggccgacgacctcgagccaggggcgacggttgacgagctcctcgaggcggtgcgccgcgccgacgccggggactccactggcgcgcgcgagatattggcgcggctcaatcaccggctcccctcaccgccggggcacccgcaccctccactcctccgcgccgcggctcacctccgggacgcgctcctgcgcgtcctcgtcacgtccgcgcccgcacccgccgccgtctcgacgaccccgctcgacgtcgcgctcaaggtagccgcgcacagggccctggcggacgcgtcaccgaccgtccagttcgccaacttcacgtccacgcaggcgctcctcgacgcgctcggcaccgcgcgccgcgtgcacgtcgtcgacttggacgtcggcttcggcggccggtgggcgccgctcatgcaggagctcgcgctccagtggcgccgagcacccgtctcgccgctgccgccgccgtgcttgaaggtgacggccttggtctcgccagggtcatcagcgcaccccttggagctccacctcacgcaccagggcctgacgcgcttcgccgccgacctcggcatctcgttcgagttcaacgccgtcgcgttcgaccccttggacccgttgccccccacggggctgtccgtcgcgcccggcgatgccgtcgccgttcacctctccgtcggctccggggtcccgtcggcagctactctccgcgtcgtgaagcagctccgccctgccgtcgtggtgtgcgtcgaccacggatgccaccgcggcgacctgccgctgtcgcaccacgcgctgagcgtcgtgcgctccagcgcggcgttcctcgagtcgctggacgcggccggggcgccggcggacgcggtggcgaggctggaggagtacgtcgtgcgtcccagggtggagcgcctgttgctaggcgacaggatgcctccatggcggaccatgcttgactccgccggattcgcgccggtgcagctcagcaacgccgccgaggcacaggccgaatgcctcgtcaggcgcacgcccacgccgggcttccatgtggagaagcggcaggcggcgctcgcgttgcggtggcaggactcggagctggtgatggtgtcggcgtggcggtgctgaatcggggcactgggacagttcctgtaaagattgaacctttttctgttctcatgtgcagtaaaattagctagtaacttgttgtcaagctgtttattttacaattttagttgcgatgatgtagcaattgggagcatgtgaattttcatcatctgtgatatgacagttctgaggaacgattggaagccacagatctgcagctaatagccccatttgccatgcccatattcctgcagttagttgctaggtccattaattgttagcattagttgggcatgcatgtggtccataatctacatttcagatccattcagagctggtacaaacaaaaaaaaaaaaaaaaaaaa

SEQ ID NO: 959 - DNA, 2256 bp, Zea mays
atggggatgatccgcaagattaatctaatgggtgtgcccctgcaggtcgaagatattctctttaatattgacaagaaaaagcaaagaaagagaggatgcttcgcatgtggggagaagggccacttcagggacaactgtccaactatgaccgaacctaaaaaggaaaggagcaaaggcaaggcgctaacaagtgtaaagacttgggatgattctttaagtgaagatgaacctccaaggacgcgcagccaccggtcctcatcacgctcatcatggtcatcacgcaaatgccttatggcaagaggtaaaatgagcattccatcctctagtgatgaaagtagtagtgatgatgaagacgacgacacatcgagggatgcccctcgccggagccgcgacggccgcgaacctgccacgactcgccccctacgcccaagtaccagcccgcccaccacgctgtcttcgccactcggcatcgccgacgtggcggccctcgccgacgccgacgccgacgccaagagcgtctccccgcccgcatggccggacgacgacgacgacgacgtcgccgggagggacgactgggtccaccatctcccgccccttgacatgcacatgccgccgctcggcctcggcgccgcagaggcctgggagccccacgcgcaacctccgggtccgggcggcctcaccctctcgcacgcccagcagacccacgacagcaccttcctcggctggtttattgccgacgacgtcgccatgtcgggcgtcatggacgaccacaactcccactcggtacttcatgacctcgaccacataccctcttcctccgtgccgccgccgcagttccagcctctcgcgccccacgtgcactacccgcccaagctgcaccaccaccaaaaccccgtggtgcccgcgtcgcctcccaagcacacgctcctgaaacccaagccggaggcgccggggaccgacgacgcttccacggcggtggaccagctcgccgaggccgccaagcttgccgaagccggagacgttttcggcgcccgcgagatactggcgcggctcaactacctgctcccgcccggcgccgcgacggcgacgccactgctccgctccgccttctacttcaaggaggctctgcgcgctgccctgtccaccaccgcctccgcaaccgccgccgccgccgccgcgccggtggacgtgctcctaaagctcggtgcctacaaggacttctccgagctctgccccgtgctccagttcgcgcacttcacctgcgtccaggccatgctcgacgagctgggtggcgctgcctgcatccacgtgctggacttggacatcggcgtcggcgagcagtgggcgtcgctcatgcaggagctggccagccgccgcccgggcgccgcgctcaaggtcaccgcattggtgtccgcggcgtcgcaccacccgctggagctgcagctcgtccacgagaacctgtccaacttcgcggccgagacgcgcgtcccgttccagctggccttcttcaacctcgacgccatggaccccgcggagctgctcgctaccgccgccggcgacgccgtcgccgtccacctcccggccggctccgtgcacgcccccgcggtgccgtccgtccttcacctcgtcaggcggcttggcgccaagcttgtcgtctccgtggaccgcagctgtgaccgcggcgagctgcccttcgccgcgcacttccagtcctgcgtgttcctgctcgagtccctggacgccgtcggcacgggccccgacatcaccgccaagatcgagcgcttcttgatccagccgaggatcgagaggtgcctggcggagaggtaccgcgccgcggcggcgggcgacaagacgccgccctggcgggcaatgctcgtgtcggccggcttcgtgccggtgcaggcaagcagcttggcggaggcgcaggcggaggcgttgctcaagaaggtgcccgtgcggggcttccgcgtcgagaagcgcgccggctcgctcgtcctgcattggcaacgcggggagctgctctccgtgtccgcctggagatgctagcaccttgctgctgctcaatctgccattgtttaaggatcctgatatatgtatcttagatagaatccacaagtctgctcgtgctttgtacaatcaaatgggggttatatggtgtatgaaatgttccctgcactcaggcattggatgcttgttttttctgtgaagttcatgatcatgagattcagaactatgaatggaaattaagttcctctt

SEQ ID NO: 960 - DNA, 2326 bp, Zea mays
caccaacgacaggggctcgccgccggcaaactctcaggcgccggcgacctctgggagcccacctcggtgcttgaccgccgacacagccccagcccgagcccgccgacctcggttcccacgctgtcgtcgcccctgggcgccgcgaccgccggtgtggcggccctcgccggtgctaacgccaagaacgtctccccgccgccggtggcggcggcggcggcatggccagggggaggaggggcggaggaggccgtggcggggggcaaggaggagtggcagctcacaccgcttgacatgggccttggcgccggcgaggggtgggacgcggccgaccccgcggcgccgccggggctcgcccccaaccacaccttcctcaggtggatcatcggcggcgaggacgcgtctgcggccatggggtctgtcatggacccgccggtccttgagctggaccacgcgccgtccatgatgtcgccggcgtttgggtccaccatgccgttcgcgccggccatggaggacgccaagccggtgcccttcggccacacgcccaacttcctgctccaccactgccaccagcaccacccccagccgcacgccgccttcttcggctcgcacccgtccctggacgcggcgccgcagccgaagcgaccacacccgatggccggggcgccggcgccgaagctgccgtctttccctgggcctgtcgcccaggcgggcggcgggttcgtgtcggccttgaagcccaaggcggaggcgggtaacgacgaggcggccgctgcggtggaccagcttgccgaggcggccagacttgccgaggccggcgacgccttcggcgcccgcgagatattggcgcggctcaattatcggctccccgccgtgcccacggccgggacgccgctgctccgctcggccttctacttcaaggaggccctgcgcgttgcgctctccccgaccggcgaggcccttgcgcccccggcggtgtcgacgccgtacgacgtggtcctgaagctcggcgcgtacaaggccttctccgaggtgtcccccgtgctccagttcgcgcacctgacctgcgtgcaggcggtgctggacgagctcggggccgccgggcgcatccacgtgctggacctggacatcggcatgggcgagcagtgggcgtcgctgatgcaggagctggcgcagcgcagccccgcggcgacgctcaaggtgaccgcattggtgtcgccggcgtcgcaccacccgctggagctgaacctcatccacgagaacctgtcgggcttcgcccgcgagctcggcgtgttcctccagttcgcggcgtacaacgtggacgccctggaccccgcggagctggtggccatcaccagcggcgacgccgtggccgtccacctccccgtggggtcggcccacgtggccgcaatgccggccgtgctccgcctcgtgaagcggctcggcgccaaggtggtggtgtccgtggaccgcggctgcgaccgcacggagctgtcgttcagcacgcacctgttacaggcgttccagtcctgcgtgtccctgctggactccatcgacgccgtggggggcgcggacgccgaggcggtcggcaggatcgagcgcttcatggtccagcccgacgtggagcggcgcgtagtgtcgcgccaccgcgcggcagtggccgtggacaagccgccgccgctgccgtggcggaccgtgctcgcgtcggcggggttcgtgccggtgcaggccagcacgttcgccgagtcgcaggccgaggccctactcaagcggatggcgctgatggggttccgcgtcgagaagcgcggcggcgcgctctgcctctactggcagcgcggcgagctggtctccgtgtcggcgtggcggtgctgaccgccgggagtacgccgccgccgccgcaaccaagagccagccgtgaatctaccacaagcccgggttagctaggactaatgatcctactactgcaagcaaaaaaatattttccaccgtcgtcgtttgtaacgatctcatctggtctggtctcgtctgtctgcttattagtgtgtcctacccgattaatcgtggagtacgtcgtccgttgcctggctttgcagcctcggtgggctctgctcatgttgatttgcggagcgcgccgtggtttgcaggttgtaaaacgtaggcgtggtgcagtgcagtgaccagcgcatcctaccgcccgtcgtgttgctactcttttttttccattgctgtgaaatcaattaatggttatggcgtttgaaaaaaaaaaaaaaaaaaaaaaaaaaaaaaaaaaaaaaaaaaaaaaaaaaaaaaaaaaaaaaaaaaaaaaaaa

SEQ ID NO: 961 - DNA, 1695 bp, Zea mays
atggaagtgactatggacgacgtggccggggatctcgagttctctggctgcagctccacgaccacctcgccgtcgtcgccatcgctggacgacggcatggggatgtacgcgtggaatgctctgtccccggtgaccgactggggctcgctctgtcctgacgacggcgcccaggatctgcacggcctcatcgagtccatgctctacgacgacacgctcctcggctcggccgacctcaacccggccatgttcccggacgacgtgtactgctgctccaatggctccgccccgagcagcaccaccacgacgaaccccggcacgcccgtgaacgacggcgacgcgcagaagggcgactgccacgagaagggcctgcgcctgctgcacttgctcatggcggcggccgaggcgctctccggcccgcaaaagagccgggagctggcccgggtgatattggttcggctcaagcagatggtctcccacatcggcgacaacgccgccgtctccaacatggagcgcctcgctacgcacttcacagacgcgctgcaggggctgctcgacggctcgcaccccgtcgggggagccggcaagcaggccgccgcggccgcgtcccacggccaccagcagcacaccggcgacgtgctgacggcattccagatgctgcaggacatgtcgccttacatgaaattcggccacttcaccgcgaaccaggccatcctggaggcggtggcgggcgagcggcgcgtgcacgtcgtcgactacgacatcgccgagggcgtccagtgggcgtcgctgatgcaggccatgacctcgcgccccgacggcgtgccgccgccgcacctgcgcataaccgccgtctcccgaggaggcggtggcagcgcccgggcggtgcaggaggccggccgtcgcctggccgccttcgcggcgtccgtcgggcagcccttctcgttcgggcagtgccgtctcgattcagacgagcggttccgtccggcgacggtccggatggtcaagggggagaccctcgtcgccaactgtgtgctcaaccaagccgccgcgacaaccaccgtcaggcgtcccaccggctcggtggcgtctttcttggctggcatggccacgctcggggccaaggtcgtgacggtggttgaggaggatcaagggcacgcggagaaggacgacgagggggcgggcggcttcgtggcgcggttcatggaggagctgcaccggtactcggcggtgtgggactcgctggaggccgggttccctacgcagagtcgtgttcgcggcctagtggagcgggccatcctcgccccaaacatcgcaggcgccgtgagccgagcgtaccgcgccgtggacggcgatggcgaggcgagggccgggtggggggagtggatgcgcggcaacgggttcagggcagtgccgttgagctgcttcaaccacagccaggccaggctgctgctcggtctgttcaacgacgggtacacgatggaggagacgtcgccgaacaagatcgtgctcggctggaaggcgcggaggctgctgtcggcgtcagtgtgggcgccgcctccggtgtcggtgccgtcgtcgccgacggagggggcgttccagcccgtggggatgtcgccggacagcggtggcgtgggccgcgtggacttcgactacattgattcgttcttcgtcgagcccgcttatgcactagtttaa

SEQ ID NO: 962 - DNA, 1007 bp, Zea mays
atgccgttcgcgccgaccatggaggacgccaagccgccgaagcgaccccacccgatggccggcgcgccaacgccgaagctgccgtctttccctgggcctgtcgcccaggcgggtggcgggttcgcgtccgccttgaagcccaaggcgaaggcgggtaacgacgaggcggccgctgcggtggaccagcttgccgagggcccgaggccggcgacgccttcggcgcccgcgagatattggcgcggctcaattatcggctccccgccatccccatggccgggacgccactgctccgctcagccttctacttcaaggaggccctgcgcgttgcgctctccccgaccggcgaggccctggcgcccccgcgcggtgttgacgtcgtacgacgtggtcctgaagctcggcgcgtacaaggtcttctccgaggtgtcccccatgctccagttcgcgcaccccacctgcgtgcaggcggtgctggacgagctcgacgtgttcctccagttcgcggcgtacaacgaggacgccctggacgccgcggagctggtggccatcaccagcggcgacgccgtggccgtacacctccccgtggggtcggcccacgtggccgcaatgccggccgtgctccgcctcgtgaagcggctcggcgccaaggtggtggtgttcgtggaccgcggctgcgacagcacggagctgccgttcgccacgcacctgttacaggcgttccagtcctgcgtgtccctgctgcgtgtccctgctggactccgtcgacgccgtggggggggagcgaacgccgaggcggtcggcaagatcgagcggttgatggacaagccgccaccgctgccgtggcggaccatgctcgcgtcggcggggttcgtgctggtgcaggccagcacgttcgccgagtcgcaggccgaggccctactcaagcggatagcgctgatggagttccgcgtggagaagcgcggcgagctggtctccatgtcgggcgtggcagtgctgaccgtcggagg

SEQ ID NO: 963 - DNA, 2444 bp, Zea mays
atgccaccgccaccgcctccgcctcctctcactccttattgccgccgctgccctcccccacacctccctccgcctcctccttcttccccaaaccacttcctcctccactacctccatcagctagaccaccaagaagccgccgccgccgccatggtccgcaagcgccccgcgtccgacatggacctcccgccgccgcgccgccacgtcacgggcgacctctccgacgtcacggcggccgctgccgccggtgttggtggtagtggcgcgccgtcctccgccagcgcgcagctgcccgcgctgcccacccagctccaccagctgccccccgcgttccagcaccacgcgccggaggtggacgtgcccgcgcacccggccccggccgcccacgcgcaggcgggcggcgaggcaaccgcgtccacgaccgcgtgggtggacggcatcatccgcgacatcatcgggagcagcggcggcgccgcggtctccatcacgcagctcatccacaacgtccgcgagatcatccacccctgcaaccccggcctcgcgtcgctcctggagctccgcctccgctccctcctcgcagccgacccggccccactgccgccgccgccgcagccgcagcagcatgctctcctgcacggcgctccggccgccgctcccgcggggctgacgctccctcccccgccaccgcttccggacaagcgccgccacgagcatccaccgccgtgccagcagcaacagcaggaggaaccgcatccggcgccgcagtcgcccaaggccccgaccgcggaagagaccgcagcggcggccgccgccgcacaagcagcagctgctgcggccgccaaggagcggaaggaggagcagcggcggaagcagcgcgacgaggagggcctccacctgctgacgctgctgctgcagtgcgccgaggccgtgaacgcggacaacctggacgacgcgcaccagacgctgctggagatcgcggagctagcgacgccgttcggcacctcgacgcagcgcgtggccgcctacttcgcggaggccatgtcggcgcggctcgtcagctcctgcctgggcctgtacgcgccgctgccgccgggctcccccgccgcggcgcgcctccacggccgcgtcgccgccgcgttccaggtgttcaacggcatcagccccttcgtcaagttctcgcacttcaccgccaaccaggccatccaggaggcgttcgagcgggaggagcgcgtgcacatcatcgacctcgacatcatgcaggggctgcagtggccggggctcttccacatccttgcctcccgccccgggggcccgcccagggtgaggctcaccggcctcggggcgtccatggaggcgctcgaggccacggggaagcgcctctccgatttcgccgacacgctcggcctgcccttcgagttctgcgccgtcgccgagaaggccggcaatgttgacccggagaagctaggggtcacgaggcgggaggccgtcgccgtccactggctgcaccactcgctctacgacgtcactggctccgactccaacacgctctggctcatccaaaggctggcccccaaggtggtgacaatggtggagcaggacctgagccactcgggctccttcctggcgcgcttcgtggaggccatccactactactcggcgctgttcgactcgctggacgcgagctacggcgaggacagccccgagcggcacgtcgtggagcagcagctgctgtcgcgggagatccgcaacgtgctggccgtgggcgggccggcccgcaccggcgacgtcaagttcggcagctggcgcgagaagctggcgcagtccgggttccgcgccgcctcgctcgccggcagcgccgcggcgcaggcgtccctgctgctcggcatgttcccctccgacgggtacacgctggtggaggagaacggcgcgctgaagctcgggtggaaggacctctgcctgctcaccgcgtcggcctggcgccccatccaggtgccgccgtgccgttgatgagacctctgcctgctcctgcttgcgttgagaggccgccactccacttgttttgcatctgtagctgctcggtttggtcatcagctgggagataagaaaagcggaaacgtactaattgctctggagtagatccatccattcacagtgatagttactgatgtactaagctttaattagttcaatgctagatcgttcttgttcaggtgtcgatcgggtatccttgtccttggtctccttttcattttggtgctttgtctagtcgctttcccggctaatgccgtgctcttcatgcgcgttgtagtgaagattcttgccgagaatattagcatagtgtttcaggtaaagtagccgtgcaagcaagtattaatttgtgggtgcgtgtcaatgacatcctaaggccatgttttgaacaccttttgcatcctaatcctagaatc

SEQ ID NO: 964 - DNA, 1413 bp, Zea mays
atgcagctggatctgaacgtggccgaggcgccgccgccggtggagatggaggcgagcgactcggggtcgtcggtgctgaacgcgtcggaagcggcgtcggcgggcggcgcgcccgcgccggcggaggagggatctagctcaacgccggccgtgctggagttcagcatcctcatccggagcgatagcgacgcggccggcgcggacgaggacgaggacgccacgccatcgcctcctcctcgccaccgccaccagcaccagcagcagctcgtgacccgcgagctgttcccggccggcgccggtccgccggccccgacgccgcggcattgggccgagctcggcttcttccgcgccgacctgcagcagcaacaggcgccgggccccaggatcgtgccgcacccacacgccgcgccgccgccggccaagaagagccgccgcggcccgcgctcccgcagctcgcagtaccgcggcgtcaccttctaccgccgcacaggccgctgggagtcccacatctgggattgcggcaagcaggtgtacctaggtggattcgacaccgctcacgccgctgcaagggcgtacgaccgggcggcgatcaagttccgcggcgtcgacgccgacatcaacttcaacctcagcgactacgaggacgacatgaagcagatggggagcctgtccaaggaggagttcgtgcacgtcctgcgccgtcagagcaccggcttctcgagaggcagctccaggtacagaggcgtcaccctgcacaagtgcggccgctgggaggcgcgcatggggcagttcctcggcaagaagtacatataccttgggctattcgacagcgaagtagaggctgcaagagcctacgacaaggccgccatcaaatgcaatggcagagaggccgtgacgaacttcgagccgagcacgtatcacggggagctgccgactgaagttgctgatgtcgatctgaacctgagcatatctcagccgagcccccaaagagacaagaacagctgcctaggtctgcagctccaccacggaccattcgagggctccgaactgaagaaaaccaagatcgacgatgctccctctgagctaccgggccgccctcgtcagctgtctcctctcgtggctgagcatccgccggcctggcctgcgcagccgcctcaccccttcttcgtcttcacaaaccatgagatgagtgcatcaggagatctccacaggaggcctgcaggggctgttcccagctgggcatggcaggtggcagcagcagctcctcctcctgccgccctgccgtcgtccgctgcagcatcatcaggattctccaacaccgccacgacagctgccaccaccgccccatcggcctcctccctccggtactgcccgccgccgccgccgccgtcgagccatcaccatccccgctga

SEQ ID NO: 965 - DNA, 2933 bp, Zea mays
ccgcttgtgcaagcgatgtccatttcatgctcatctctctctctgtctctcattggcagggactgtgggaaacaggtgtacttgggtgagttcccgtccaatcgaaaagaactgagactcgaattacgtactacactagcatcatttcatggcatttaatcaggtgtccgaattgctctttttctaggtggattcgacacggcgcaggccgctgcgaggttcatagatttcttcttcctcgcgcgcatctgttccatcttctcgtcttatcttatatatctatatatctatgaatctatctgcagggcctacgaccaagccgcgatcaagttccgcggcgtgaacgcggacatcaacttcaccctggacgactacaaggacgagatgaagaaggtgattccccccctgttgcaattgcgaatcgaacgaccaacaccggtagaagaaggagcccacacacaccgccatgaatggagtgtgaatagaacaagttaagaacataaaattaggctggtacaggtatggtaattcccgggatcccctttctctcttctatctatatattacccccctcaggccggccgggccgggctccccaccctccttcctcagctccgttgcgcaccgccaccgccggccggccagccgccggagcaccgaaagacccccgttctttcctgtaaaaaaaaacccgccgcctttagctagctaaccggtcgtcctcttcaccccctagctttgctagctctagctaggaacgaaagaaattaaaggataactgagattgctgattggtggtccgggtacggtgttcttgagtcgtgaagcgacagtacagtggctagggtcgtgccgcccctgcagtctccggggttgcgtgcaggatggtcgtcagggatcgggagtgaggaggcatcagctctcgcggtcgtggagcctaaatgtaccgcaacaacgactcggcactctcctgcttctacctcttcctcctctggttcttcttcttgaagtagacaccaccagttcgccaggtagttagcagcccagttgcgactggggatcggtggcgggctgccgcttgcgagttgtaagcttggaggggaggggagcaggagcaggagatgcagctggatctgaacgtggccgaggcgccgccgccggtggagatggaggcgagcgactcggggtcgtcggtgctgaacgcgtcggaagcggcgtcggcgggcggcgcgcccgcgccggcggaggagggatctagctcaacgccggccgtgctggagttcagcatcctcatccggagcgatagcgacgcggcccggcgcggacgaggacgaggacgccacgccatcgcctcctcctcgccaccgccaccagcaccagcagcagctcgtgacccgcgagctgttcccggccggcgccggtccgccggccccgacgccgcggcattgggccgagctcggcttcttccgcgccgacctgcagcagcaacaggcgccgggccccaggatcgtgccgcacccacacgccgcgccgccgccggccaagaagagccgccgcggcccgcgctcccgcagctcgcagtaccgcggcgtcaccttctaccgccgcacaggccgctgggagtcccacatctgggattgcggcaagcaggtgtacctaggtggattcgacaccgctcacgccgctgcaagggcgtacgaccgggcggcgatcaagttccgcggcgtcgacgccgacatcaacttcaacctcagcgactacgaggacgacatgaagcagatggggagcctgtccaaggaggagttcgtgcacgtcctgcgccgtcagagcaccggcttctcgagaggcagctccaggtacagaggcgtcaccctgcacaagtgcggccgctgggaggcgcgcatggggcagttcctcggcaagaagtacatataccttgggctattcgacagcgaagtagaggctgcaagagcctacgacaaggccgccatcaaatgcaatggcagagaggccgtgacgaacttcgagccgagcacgtatcacggggagctgccgactgaagttgctgatgtcgatctgaacctgagcatatctcagccgagcccccaaagagacaagaacagctgcctaggtctgcagctccaccacggaccattcgagggctccgaactgaagaaaaccaagatcgacgatgctccctctgagctaccgggccgccctcgtcagctgtctcctctcgtggctgagcatccgccggcctggcctgcgcagccgcctcaccccttcttcgtcttcacaaaccatgagatgagtgcatcaggagatctccacaggaggcctgcaggggctgttcccagctgggcatggcaggtggcagcagcagctcctcctcctgccgccctgccgtcgtccgctgcagcatcatcaggattctccaacaccgccacgacagctgccaccaccgccccatcggcctcctccctccggtactgcccgccgccgccgccgccgtcgagccatcaccatccccgctgagagaatcaagaagccgcactgtaaatctgccgggaagctagcattttccccccggcccctccccctctccgggcgttgcgactttttcagttttgcgccgccggccggggtggtggtttcttgtagccgatcgattggattcctcgtattactgctgcttacactcccaattaagtgcttgttcggctattggctactctttcccctaccccccctgttagctgatcgattggacgtacttgctagctgctgttgctgctgctagcttgagattgactaacttcagcacttggattgatttaaaaaaaaaaaaaaaaaaaaaaaaaaaaaaaagggcggccatcccgggaattccggaccggtaccagcctgcttttttgtacaaacttgttctatag

SEQ ID NO: 966 - DNA, 2125 bp, Zea mays
aattcggcacgaggatttcttccctggctgaaggcgtgggtctcgagagctgcttaaaaagctttgcacaaaaatggcttcgccggcgataccattcgcccccctcacgtcccatcgcgccgctcccttcgtcctggggtgtcctcctccatggccaccgccaccgccgcctgccgctcgcccacggccgccgccgccgcgccctgacgctgctgctgctgctagactgctagaggaggaggccggggcaggcagctcgcgagctcgatcgcctggcgggcccgagctggagtcgatggtgctggatctcaatgccgagtcgccgacgcccggctcggcctcggccgcctcgagctccagcgtcgtagtgggcgggggcttcttccggttcgacctgctcggagggacacccgacgaggagggttgctcgccctcgccacccatcgtgacgcgccagctcttccccttgccgtacccggacgctgcaggtagcaccgccgcctcgacggcgtcgaacgggtcgccgccgccggaggtggcgggggcatgggcgcgccgcccagcggatctcggggcgccggcgctggcacaggggaaggtggtgtctgcgccttcgtcgcccgcggttgtgtctcctgccgccgggaagaagagccggcgggggcccaggtcgcggagctcgcaataccggggcgtcaccttctacaggaggaccggccgctgggagtcacacatctgggactgcgggaagcaggtctacctgggtggatttgatactgcgcacgccgcagcaagggcctatgatcgcgctgccatcaagttcagaggccttgacgccgacatcaacttccagttgaaggactatgaagatgacttgaagcagatgaggaattggactaaggaggagtttgttcacatactccgacgtcaaagcactgggtttgccagggggagctcaaagtaccgtggtgtgacactacacaagtgtggtcggtgggaagctcggatggggcagcttctcggaaagaagtacatctaccttggtctatttgacagtgaaatcgaagcagcaagagcgtatgatagggcagccattcgcttcaatggaccggatgctgttacgaactttgattctgtttcctatgatggagatgtcccacttccacctgcagttgagaaagatgtggttgatggagacatccttgatctgaatttgaggatttcacaacctaacgtgcatgatctcagaagtgatggtaccctgactggttttggattaagttgtaattctcctgaagcttcaagctccattgtttctcagccaatgggcccccagtggcctgtccatcctcacagcagatcgatgcggccccagcatccacatctgtatgcatctccttgtccaggcttctttgtgaacctcagggaggcgcctatgcaggaagaggagaaccggtccgagccgggcgtgtccccagccgttcccctcctggtcctgggcatggcaaacgcagggctcccgtgccccagttctccctgccaccactgcagcatcatcaggattctctaccgccgctgccaccggcgtggacgcggccacagccggccacagcgtgccgccgccgtctggtagcctccggcagttctcgggctaccaccagctccgcttccccccaaccgcctgacggagacagaccacctcctgttgagttggcggcggcggcggcgtctcatagctggccggtggttggctggctgcccatgcaacgccacgccggtgggtgcgggtcggtattcggtaacagtcgccactgttgggtatggttttgtgggactacagaggatgcagtgatctctcgctgctgctgtgtgctgtctctctcgctccctctacccacccacacctgtttgtaatatgaatttatcgccctctcgcgctcgtgattcgtccatcttcgtttcgttttgatggccaccggatgggatcatgagcgtgttgcgagaaattgtgtaataaaccatgcgtatttttatttatatttatttattgtgacgatggtaaaaaaaaaaaaaaaaagggcggccgctctagagtatccctcgaggggcccaagcttacgcgtac

SEQ ID NO: 967 - DNA, 2205 bp, Zea mays
ctctgcttgtgcttgtgcaatgcagggattgcggcaagcaggtctatttgggcgggtttgacaccgctcatgcggcggctcgggcgtacgatcgggcggcgatcaagttccgcggcgtggaggccgacatcaatttcagtctggaggattaccaggacgacatgaagcaggtgatttatactcctatacggagcatgtagcgagaaagatacatgtaattttttctttccttcgtctaccagcagatgggccacctgagcaaggaggagttcgttcacgtgctccggcggcagagcacggggttcccccggggcagctccaagtacagaggcgtgacgctccacaagtgcgggaggtgggaggcgcgcatgggccagttcctcggcaagaagtacgtctacttgggcctgttcgacaccgaggaggaagccgccaggtaaaataattggaccgcactgtgtgcccgcgaggcgtttctcggagcaccgccacccccctctgggccgcgaaactgactgatggatggatgccccgtgtctgtgggattgtcgggtcgtgtgtgtgtgtgtgtgtgtgcagggcgtacgaccgcgcggccatcaagtgcaacggcaaggacgcggtgacaaacttcgatcccagcatttacgccgaggagctcgagccggcgggttcgtctatcccccgcccgcgatctccgccacgatcgcgccccctcgtcgctgtgcggcgatttcgctacaggctacagcctatacaggcaagctctgacggtccgctgtttcgccgtgcagcgtcgacgggcggcggtggcgatgaccacaatcacaacctggacctgtcgctggggagctcggcggggaacaaaaggggcagccttgacgacggcggcggcggaggaggcggcggcgacgacgagacctcggaccagcgcgtccccatggcgttcgacgtcgactggcagacggccgcgccccggagcacgaaagcaaagctggacgcgagctccaagcaaccccagacccagatgctgcctcctccgcctcctgctgtcttgcgagtcgcccaccagctgccgttgccgttcggtcccaggcatccgcaatcgcagttcctgagcaacggcggcgattcggggacctcgggaggcctgtccctcgcgatcggcggcgcgggcggcgggcactggcctccccagctgcagcacctgcagcagcagaggctgcacggcgcctgggccaacggcggcggcacgagctggccgcctccgccgcacccgcacccgcacccgcacccgccgccaccgagcaccgccgcgaccgcagctgcagcatcatcacgattccctccctacgttgttactacgacgcaaggcccggcaggctgggctcagaagaatgggttccattcgctggccaggccaacctagtatgccaagaaccacgactggccggagcgttcattcgtcgtcgatcgtcgacccagggcaaacgacacctccaaccactgcacgacgacgttttaatttaccggatgccattctctctctcccctccccccttcccttctcccttctcccttctcccttctctgtgttcttgattgggtgagacatggatccgaggatggatggacggcctgtacctgaggagttcccgggaagaagacgagtgagtgagtgagtgattggtagggtaggcgactaggcgtcgcgtcaggcagtacgtccttttggcgccttttttcttctttcactcaccattggcgaccaccaatgaatgatgacactgactggggtgtcaacatcgcagctggttttgtttggtctcatgttgcatcactcgctgctccacgatgccttgctatggttggggggagatttgctccatccaccccacgccggtcaggcgacagagcctccgctgcgtcgtctcatccgtctggtgagttgccactgtcttagaatctgagtggtacggtacgtgtggatctcgcgcgcgtgtaaacctagtattatgtactacaaactgtcatcatcggagatcactcgaataagatatcgatcttgagattacgggcggcggctcctgtcatgtgcttactacagcaaagctgataaactgtccgagtctgaacagctcatgtaatggaacgccgcatagatatttccttcttgttaggggtactttggaaccccaatttttt

SEQ ID NO: 968 - DNA, 2242 bp, Zea mays
acgacgcggacgacgactcggccgccgccgccgcggaagccgtcgtcacgcgccagttcttcccggccccggccgccgtcggcgcggcgcccgggcccggctcgtcgagcgcgcgcgcgggctggcttcgcctggccgccgcggctccaccgcccgcggcgggcggcagtaacggcgtcgcgcaaaccggtggccccgcggcggcggcggcggcggctggcaagaagagccggcgcgggccgcggtcgcgcagctcgcagtaccgcggcgtcacgttctaccgccggacggggcggtgggagtcgcacatatgggattgcggcaagcaggtctatttgggtaagtttcgttcatgtccatgcatacacatccgtacttgggagagaggtgggtgactgccccaatccgaggcgttttcggttctggatccctcacaaatggcttggcttgtggacgacttgcaggcgggtttgacaccgctcatgcggcggctcgggcgtacgatcgggcggcgatcaagttccgcggcgtggaggccgacatcaatttcagtctggaggattaccaggacgacatgaagcagatgggccacctgagcaaggaggagttcgttcacgtgctccggcggcagagcacggggttcccccggggcagctccaagtacagaggcgtgacgctccacaagtgcgggaggtgggaggcgcgcatgggccagtgtcactgcaggtacgtctacttgggcctgttcgacaccgaggaggaagccgccaggtaaaataattggaccgcactgtgtgcccgcgaggcgtttctcggagcaccgccacccccctctgggccgcgaaactgactgatggatggatgccccgtgtctgtgggattgtcgggtcgtgtgtgtgtgtgtgtgtgtgcagggcgtacgaccgcgcggccatcaagtgcaacggcaaggacgcggtgacaaacttcgatcctagcatttacgcggaggagctcgagccggcggcgtcgacgggcggcggtggcgacgaccacaacctggacctgtcgctggggagctcggcggggaacaaaaggggcagccttgacgacggcgtcggcggcggcggcgaagacgagacctcggaccagcgcgtccccatggcgttcgacgtcgactggcagacggccgcgccccggagcacgaaagcaaagctggacgcgagctccaagcaaccccagacccagatgctgcctcctccgcctcctgctgtcttgcgagtcgcccaccagctgccgttgccgttcggacccaggcatccgcaatcgcagttcctgagcaacggcgatccggggacctcgggaggcctgtccctcgcgatcggcggcgcgggcggcgggcactggcctccccagctgcagcacctgcagcagcagaggctgcacggcgcctgggccaacggcggcggcacgagctggccgcctccgccgcacccgcacccgcacccgccgccaccgagcaccgcagctgcagcatcatcacgattccctccctacgttgttactacgacgcaaggcccggcaggctgggctcagaagaatgggttccattcgctggccaggccaacctagtaggccaagaaccacgactggccggggcgttcattcgtcgtcgatcgtcgacccagggcaaacgacacctccaaccactgcacgacgacgttttaagttaccggatgccattctctctctccccctcccccttcccttctcccttctcccttctctgtgttcttgattgggtgagacatggatccgaggatggatggacctgtacctgaggagttcccgggaagaagacgagtgagtgagtgagtgattggtagggtaggcaactaggcgtcgcgtcaggcagtacgtccttttggcgcctttttttcttctttcactcaccattggcgaccaccaatgaatgatgacactgactggggtgtcaacatcgcagctggttttgtttggtctcatgttgcatcactcgctgctccacgatgccttgctatggttgggtgagatttgctccatccaccccacgccggtcaggcgacagagcctccgctgcgtcgtctcgtccgtctggtgagttgccactgtcttagaatctgagtggtacggtacgtgtggatctcgcgcgcgtgtaaacctagtattatgtactacaaactgtcatcatcggagatcactcgaataagatatcgatcttgag

SEQ ID NO: 969 - DNA, 2246 bp, Zea mays
  misc_feature (26)..(26): n is a, c, g, or t
  misc_feature (28)..(28): n is a, c, g, or t
cccctccccccttcccttctcccttntntgtgttcttgattgggtgagacactctgcttgtgcttgtgcaatgcagggattgcggcaagcaggtctatttgggcgggtttgacaccgctcatgcggcggctcgggcgtacgatcgggcggcgatcaagttccgcggcgtggaggccgacatcaatttcagtctggaggattaccaggacgacatgaagcaggtgatttatactcctatacggagcatgtagcgagaaagatacatgtaattttttctttccttcgtctaccagcagatgggccacctgagcaaggaggagttcgttcacgtgctccggcggcagagcacggggttcccccggggcagctccaagtacagaggcgtgacgctccacaagtgcgggaggtgggaggcgcgcatgggccagttcctcggcaagaagtacgtctacttgggcctgttcgacaccgaggaggaagccgccaggtaaaataattggaccgcactgtgtgcccgcgaggcgtttctcggagcaccgccacccccctctgggccgcgaaactgactgatggatggatgccccgtgtctgtgggattgtcgggtcgtgtgtgtgtgtgtgtgtgtgcagggcgtacgaccgcgcggccatcaagtgcaacggcaaggacgcggtgacaaacttcgatcccagcatttacgccgaggagctcgagccggcgggttcgtctatcccccgcccgcgatctccgccacgatcgcgccccctcgtcgctgtgcggcgatttcgctacaggctacagcctatacaggcaagctctgacggtccgctgtttcgccgtgcagcgtcgacgggcggcggtggcgatgaccacaatcacaacctggacctgtcgctggggagctcggcggggaacaaaaggggcagccttgacgacggcggcggcggaggaggcggcggcgacgacgagacctcggaccagcgcgtccccatggcgttcgacgtcgactggcagacggccgcgccccggagcacgaaagcaaagctggacgcgagctccaagcaaccccagacccagatgctgcctcctccgcctcctgctgtcttgcgagtcgcccaccagctgccgttgccgttcggacccaggcatccgcaatcgcagttcctgagcaacggcgatccggggacctcgggaggcctgtccctcgcgatcggcggcgcgggcggcgggcactggcctccccagctgcagcacctgcagcagcagaggctgcacggcgcctgggccaacggcggcggcacgagctggccgcctccgccgcacccgcacccgcacccgccgccaccgagcaccgcagctgcagcatcatcacgattccctccctacgttgttactacgacgcaaggcccggcaggctgggctcagaagaatgggttccattcgctggccaggccaacctagtatgccaagaaccacgactggccggagcgttcattcgtcgtcgatcgtcgacccagggcaaacgacacctccaaccactgcacgacgacgttttaatttaccggatgccattctctctctcccctccccccttcccttctcccttctcccttctctgtgttcttgattgggtgagacatggatccgaggatggatggacctgtacctgaggagttcccgggaagaagacgagtgagtgagtgagtgattggtagggtaggcgactaggcgtcgcgtcaggcagtacgtccttttggcgccttttttcttctttcactcaccattggcgaccaccaatgaatgatgacactgactggggtgtcaacatcgcagctggttttgtttggtctcatgttgcatcactcgctgctccacgatgccttgctatggttgggggagatttgctccatccaccccacgccggtcaggcgacagagcctccgctgcgtcgtctcgtccgtctggtgagttgccactgtcttagaatctgagtggtacggtacgtgtggatctcgcgcgcgtgtaaacctagtattatgtactacaaactgtcatcatcggagatcactcgaataagatatcgatcttgagattacgggcggcggctcctgtcatgtgcttactacagcaaagctgataaactgtccgagtctgaacagctcatgtaatggaacgccgcatagatatttccttcttgttaggggtactttggaaccccaattttttaagagatttttatttttcc

SEQ ID NO: 970 - DNA, 1351 bp, Zea mays
ggcaggccatgctctctctctctctctctcttcctcctcctctccctctgggtgtccccgtcccctgcctctctctctctctcacatccccatgctctctgcttgtgcttgtggcaatgcagggattgcggcaagcaggtctatctgggcggatttgacaccgcccatgcggctgctcgggcgtacgatcgagcggcgatcaagttccgcggcgtggaggccgacatcaatttcagcttggaggattaccaagacgacatgaagcagacaaatgtgccacctgagcaaggaggagttcgttcacgtgctccggcggcagagcacggggttcccccggggcagctccaagtacaggggcgtgacgctccacaagtgcgggcggtgggaggcgcgcatggcccagttcctcggcaagaaatatgccggtacgtctacttgggcctgttcgacaccgaggaggaagccgccagggcgtacgaccgcgcggccatcaagtgcaacggcaaggacgcggtgacaaacttcgatcccagcatttaccccgaggaggaggtcgcgccggcggcggcgacgggcggcgccgccggcgacgagcacaacctggacctgtcgctgggaagctcggcggggaacaaaaggggcagccttgacggcggcggcggcggcggcggcgacgacaagtcctcggaccagcgcgtccccatggcgttcgacatcgactggcagacggccgcacgtcggagcaccaaggcaaagctcctgagcaacggcgatccggggaccgcggcgggaggcctttccctggcgatcggcggcggaggcgggcactggcctccgcagctgcagcatcagcagcagcagcagaggctccacggcgccaggaacaacggcggcggcacgagctggccgccgccgcccgcccccgtgcccgccgccagtaccggccgccgccgcgaccgcagctgcagcatcatcacgattccatccctacgttgttacgagtacgacgcaaagcccggccggctgggtccagaagaatgggttccattcgctggccaggcccacgtagaccaagaaccaggactgggcgttcgtccttcgatcgtattccacggcgaaggtccatcatttgacccaagggcaaacggctcgtcgatccaccgatttacaccccctccccctttctttcccttttccattctctgtgttcttgattgggtgagacatggatccgaggatggatgggcctgctgcccccctgctgtaaatgaggagtttccgggaagaagacgagtgctttggtaggcgactaggcgtcgcgtcaggcagtgcgtccttttgccgcttttta

SEQ ID NO: 971 - DNA, 3098 bp, Zea mays
  misc_feature (303)..(303): n is a, c, g, or t
  misc_feature (305)..(306): n is a, c, g, or t
atgcatcccggcgcatagatagagagagagaagagagagccccgactcgagagccaagaacgccgtgtgctgtgtttgtgtgcatctatctccgtacacgcacgctcgcacgcaccagctagcacgaccgccatggccgccaccaggagagcattcttccacagcgccgtcgacggcattgcgcgcgccgggccgggggaagccgagctgctgccggcgccgccgcaggtcgggcgaccggtggaaggcgccagcagcatggtcttcggcttccccgtgccgcggcccacgatgccggacagncnnggcggcgccgtcaccaagcagttctttccgcccactactacggcggcgcaccaggcgacaatggaagagagaatggcacgtgccccgccggtaggggggcggagcaatggtgttcatcagttcgtcaggaaggtcctagaatgagagaacattcagtttattaaagagtgatgcatgcagaattcggcacgaggtccttctcctattctatctatatatcacccgcctctttttccgccctcgccacgacgcaccttccctcttcttcctcagctccgtcgcccaccgccggagctccgaaaggccccgcgctcgccgcctttcctgtaaaaaacccaacctttagctagctaaccgctcctcttctccccctacgtactccccttgcccaaatcagagaagatatttaacggaggaggggaaggagaggatatttagctgattgttgattggtggtccggggtacggtgttcttgagtcgtgaagcgaccgtacggtggctagggccgtctccgggttgcgtgcaggatggtcgtcagagatcgggagtgaggaggcagctcgtggtcgtggaggctaaatgtaccgcaagaacgactcggcactctcctgtttctacctcttcctcctctggttcttcttcttgaaatagaccagcgccagccaccaggtagctacctactagctagcagcccagttgcgactggggacgggctgctgcttgcaagttggaatcttggagcaggagcagaggagcgggagatggagctggatctgaacgtggccgaggtggcgccggagaagccatcggcggcgctggaggcgagcgactcggggtcctcgggctcgtcggtgctgaacgcggaggcggcatcggcgggcggcggggggcccgcgccgggggaggaggggtcaagctcgacgccggccgtgctcgagttcagcatcctcaggagcgacagcgacgcggccggcgcggacgccgacgacggcgacgccacgccgtcgccacctcgccaccaccagcagcagctcgtcacccgggagctcttcccggcgccgcagcattgggccgagctcggcttcttccgcgccggcccgcagcagcagccggacatcagggtcctgccgcacccgcacccgcacccgcccccgccgccgcccgcgcagccgcagccggccaagaagagccgccgcggcccgcgctcccgcagctcgcagtaccgcggcgtcaccttctaccgccgcaccggccgctgggagtcccacatctgggattgcgggaagcaggtgtacttaggtggattcgacactgctcatgccgctgcaagggcgtacgaccgagcggcgatcaagttccgcggcgtcgacgccgacataaacttcaacctcagcgactacgacgacgatatgaagcagatgaagagcctgtccaaggaggagttcgttcacgccctgcggcggcagagcaccggcttctcccgcggcagctccaagtacaggggcgtcaccctgcacaagtgcggccgctgggaggcgcgcatggggcagttcctcggcaagaagtacatatatcttgggctattcgacagcgaagtagaggctgcaagggcgtacgacaaggccgcgatcaaatgcaacggtagagaggccgtgacgaacttcgagcccagcacgtacgacggggagctgctgctgactgctgaagctagcgcagaagttgctgacgacgttgatctgaacttgagcatctcgcaaccggcatcgtcccagagccccaaaagagacaagaactgccttggtccgcagctccaccaccaccatgggcggccgtttgacggctccgccgttctgaagaaaaccaagatcgatgctccgtctgagctgtcgtcggcgggccgccctcaccggtcgttcctccctcatctcgtggctgccgagcatctaccgcctcggtctcaccccttcttcatcacacaccatgagagtgatgcatcaagaagagatcccagctgggcagcagcagcagcatggaaggtgaccgcagctgcacctcctcctcctaccaccaccctgttgccgttgccgctgccgtcgacgtcgtccgctgcagcatcatcaggattctccaataccgccacgacagctgccgccgccccatcggccgcctcctcccgccggttcgacccgccgccaccgtcgtcgtcctcctcctcgagccatcaccaccaccaccaccgccgctgagaatcgaagaagccacactgtaaatctgccgggaagcggctggtggcatccggcccgctcctccctccggggcgccgcaacttttttcgatcggttttgcgccgcccgggacgggttgtagttgatcgattggattcttcataactgtatttgcgtactgcttacactacccaagtgaaatcgaaaatggcgccttctctcgttgaataaaaaaaaaaaaaaaaaaaaaaaaaaaaactcgaggaaaactcgaaggggcgggtctggcggggtgggaaaaaggtctgagcagttttgagcgtccggaggagctggaggatttcctgccctggaatagtcacttggggtggccactagttattattttctttccttccccctcgttgattctgctacccattaatagcttctgtatctagctacatgcatgatgctgctctagcgctgttggacgttgatggcacggtgtacggatatgggacagggttcgtgtgaccccatgtccactgctaggcctgtttccaaatggaaaataaaaaaaaaaa

SEQ ID NO: 972 - DNA, 1821 bp, Zea mays
actcggggtcgtcggtgctgaacgcgtcgaaagcggcgtcggcgggcggcgcgcccgcgccggcggaggagggatctagctcaacgccggccgtgctggagttcagcatcctcatccggagcgatagcgacgcggccggcgcggacgaggacgaggacgccacgccatcgcctcctcctcgccaccgccaccagcaccagcagcagctcgtgacccgcgagctgttcccggccggcgccggtccgccggccccgacgccgcggcattgggccgagctcggcttcttccgcgccgacctgcagcagcaacaggcgccgggccccaggatcgtgccgcacccacacgccgcgccgccgccggccaagaagagccgccgcggcccgcgctcccgcagctcgcagtaccgcggcgtcaccttctaccgccgcacaggccgctgggagtcccacatctggtcagtactaccactgtctacaactagccacaccacaccgattgcttccgactctcattaatttctgacacaaactcgccgccctcccccccggctcccccgccgctgggattgcggcaagcaggtgtacctaggtggattcgacaccgctcacgccgctgcaagggcgtacgaccgggcggcgatcaagttccgcggcgtcgacgccgacatcaacttcaacctcagcgactacgaggacgacatgaagcagatggggagcctgtccaaggaggagttcgtgcacgtcctgcgccgtcagagcaccggcttctcgagaggcagctccaggtacagaggcgtcaccctgcacaagtgcggccgctgggaggcgcgcatggggcagttcctcggcaagaaagcttacgacaaggccgccatcaaatgcaatggcagagaggccgtgacgaacttcgagccgagcacgtatcacggggagctgccgactgaagttgctgatgtcgatctgaacctgagcatatctcagccgagcccccaaagagacaagaacagctgcctaggtctgcagctccaccacggaccattcgagggctccgaactgaagaaaaccaaggcaagcgctaacgatagatataccttgacaagctagtatcaaacaaaaccagtaaaaaaagtttactttcttgtcgaatttcattgcctacctgtacgtacttgtgcttctgcacaaaataacgaaatccttttgccctctgatgatgatgcagatcgacgatgctccctctgagctaccgggccgccctcgtcagctgtctcctctcgtggctgagcatccgccggcctggcctgcgcagccgcctcaccccttcttcgtcttcacaaaccatgagatgagtgcatcaggagatctccacaggaggcctgcaggggctgttcccagctgggcatggcaggtggcagcagcagctcctcctcctgccgccctgccgtcgtccgctgcagcatcatcaggattctccaacaccgccacgacagctgccaccaccgccccatcggcctcctccctccggtactgcccgccgccgccgccgccgtcgagccatcaccatccccgctgagagaatcaagaagccgcactgtaaatctgccgggaagctagcattttccccccggcccctccccctctccgggcgttgcgactttttcagttttgcgccgccggccggggtggtggtttcttgtagccgatcgattggattcctcgtattactgctgcttacactcccaattaagggcttgttcggctattgatattacatgtgtattggagtgtattgagtgggattgtgatgtattttgacttgtta

SEQ ID NO: 973 - DNA, 1455 bp, Zea mays
atgtgggaccttaacgactcgccggccgccgaggccgccccgccttccccgtccgccgacgactccggcgcgtcctcctcgtcggcggccgcgctggtcgagatacccgacgacgcggacgacgactcggccgccgccgccgcggaagccgtcgtcacgcgccagttcttcccggccccggccgccgtcggcgcggcgcccgggcccggctcgtcgagcgcgcgcgcgggctggcttcgcctggccgccgcggctccaccgcccgcgggcgggcggcactcgcagtaccgcggcgtcacgttctaccgccggacggggcggtgggagtcgcacatatgggcgtacgatcgggcggcgatcaagttccgcggcgtggaggccgacatcaatttcagtctggaggattaccaggacgacatgaagcagcagatgggccacctgagcaaggaggagttcgttcacgtgctccggcggcagagcacggggttcccccggggcagctccaagtacagaggcgtgacgctccacaagtgcgggaggtgggaggcgcgcatgggccagttcctcggcaagaagtacgtctacttgggcctgttcgacaccgaggaggaagccgccagggcgtacgaccgcgcggccatcaagtgcaacggcaaggacgcggtgacaaacttcgatcccagcatttacgccgaggagctcgagccggcggcgtcgacgggcggcggtggcgatgaccacaatcacaacctggacctgtcgctggggagctcggcggggaacaaaaggggcagccttgacgacggcggcggcggaggaggcggcggcgacgacgagacctcggaccagcgcgtccccatggcgttcgacgtcgactggcagacggccgcgccccggagcacgaaagcaaaggtacccgttcggttcggtctcgcgttccgcatcaacgaggcgtgtcttgtaaaatgttgcctaataaagcaagctttgtcacgtttcaaccaccgggtacggtggccggcgcagctggacgcgagctccaagcaaccccagacccagatgctgcctcctccgcctcctgctgtcttgcgagtcgcccaccagctgccgttgccgttcggtcccaggcatccgcaattcctgagcaacggcggcgatccggggacctcgggaggcctgtccctcgcgatcggcggcgcgggcggcgggcactggcctccccagctgcagcacctgcagcagcagaggctgcacggcgcctgggccaacggcggcggcacgagctggccgcctccgccgcacccgcacccgcacccgcacccgccgccaccgagcaccgccgcgaccgcagctgcagcatcatcacgattccctccctacgttgttactacgacgcaaggcccggcaggctgggctcagaagaatgggttccattcgctggccaggccaacctag

SEQ ID NO: 974 - DNA, 690 bp, Zea mays
atgaggaattggactaaggaggagtttgttcacatactccgacgtcaaagcactgggtttgccagggggagctcaaagtaccgcggtgtgacactacacaagtgtggtcggtgggaagctcggatgggtcagcttctcggaaagaagtacatctaccttggtctatttgacagtgaaatcgaagcagcaagagcgtatgatagggcagccattcgcttcaatggaccggatgctgttaggaactttgattctgtttcctatgatggagatgtcccacttccacctgcaattgagaaagatgtggttgatggagacatccttgatctgaatttgaggatttcacaacctaacgtgcatgatctcagaagtgatggtaccctgactggttttggattaagttgtaattctcctgaagcttcaagctccattgtttctcaggaggcgcctatgcaggaagaggagaaccggtccgagccggcgtgtccccagccgttcccctcctgggcatggcaaacgcagggctcccgtgccccagttctccctgccaccactgcagcatcatcaggattctctaccgccgctgccaccggcgtggacgcggccacagccggccacagcgtgccgccgccgtctggtagcctccggcagttctcgggctaccaccagctccgcttccccccaaccgcctga

SEQ ID NO: 975 - DNA, 1143 bp, Zea mays
atggctcttgacgacttccatttcctcctcctcctttcgctgctgctcctgcttgatttgagcagggattgcgggaagcaagtctacctaggtggttttgacactgcgcacgcagccgcgaggttagggagcgtttgcttgtttgaattcgcgtccatttgcatttctgtgatcgataggcgcgttgacacggtcaagtttggatcaagcagggcatacgatcgagctgcgatcaagttccgcggcctcgacgctgacatcaacttcagtctgagcgactacgaggatgatttgaagcagatgaggaattggaccaaggaggagttcgtgcacatactccggcgccagagcacggggttcgcgaggggaagctccaagtaccgtggcgtgacgctgcacaagtgcggccgctgggaagctaggatggggcaacttcttggcaagaagtacatctatcttgggctctttgacagcgaagttgaggcggcaagggcttatgacagggctgcccttcgcttcaatgggagggaagctgttactaactttgagcctagctcctacaatgcaggagataataacctgcgtgacaccgaaaccgaggtatctgaggtgtatctcatggttctctctacgttgtcagcaattgatgatggtgatgccattgatttggatttgcggatttcacagcctaatgtgcaagaccccaaaagggacaataccttagctggcctccagccaacatgtgattcccctgaatcttcaaatacgatggcttctcagaatcatgaaagattaatcatgctcgccgatatccaatcttggttgtttgttcgctctgtttcctgtgaacgacttaaaggtggaaacgttcactgtggtcaaaacctgacaaacaaagctcatgctcgtgctgctgcgatcctgcaggtccaggaaaggccggtggagcgaaggcctgagctgggcgcccagccattcccctcatgggcatggcaagcgcagggctcccctcacgtgccgttgcaccactctgcagcatcatcaggattctctaccgccgccggggccaacggcggcatgcccctgccgtctcacccgccggcgcagttcccgactactacaaacccgttcttcttcccctag

SEQ ID NO: 976 - DNA, 1752 bp, Zea mays
ttttttttttttttttttgagtcataaaatctcagctcttcaaagatccagttataatgatgtacacgcatggtccactacaacaaaatactactactgtctcggaaaacaatccatgcatggagatatcccataccctaacaggcacataccagagggagaccagccatgtcgcttcttattatggctctctctctctctctcacacacacaaaacacaatcactttcttccatcaccagagctgctagacgccacacgcaagaccagctgccatcccagacgccgagcgagagctgagccgaaacagcaagctgtcatgtcaaaagcgatctaggggaagaagaacgggtttgtagtagccgggaactgcgccggcgggtgagacggcaggggcatgccgccgttggccccggcggcggtagagaatcctgatgatgctgcagagtggtgcaacggcacgtgaggggagccctgcgcttgccatgcccatgaggggaatggctgggcgcccagctcaggccttcgctccaccggcctttcctggacctggtggttcggaaagaagccatgacaagctgacgagtacaagcgctgatggtgagatgacactgctgggttttggtgatacccgggccaaggggatgatgagctcattggctgagaagccatcgtatttgaagattcaggggaatcacatgttggctggaggccagctaaggtattgtcccttttggggtcttgcacattaggctgtgaaatccgcaaatccaaatcaatggcatcaccatcatcaattgcctcggtttcggtgtcacgcaggttattatctcctgcattgtaggagctaggctcaaagttagtaacagcttccctcccattgaagcgaagggcagccctgtcataagccctaccaaattgcaacaagcattaaaaaaaatcagcagcgaagttaacaaagctgatgaatgaaaccagcatgtccttagaaaatgagacgtggaaggcagctacagtggcaccatgccgcctcaacttcgctgtcaaagagcccaagatagatgtacttcttgccaagaagttgccccatcctagcttcccagcggccgcacttgtgcagcgtcacgccacggtacttggagcttcccctcgcgaaccccgtgctctggcgccggagtatgtgcacgaactcctccttggtccaattcctcatctgcttcaaatcatcctcgtagtcgctcagactgaagttgatgtcagcgtcgaggccgcggaacttgatcgcagctcgatcgtatgccctcgcggctgcgtgcgcagtgtcaaaaccacctaggtagacttgcttcccgcaatccctgctcaaatcaagcaggagcagcagcgaaaggaggaggaggaaatggaagtcgtcaagagccatagattagcacagtagtagatggtaattacgaagggtgcagacgaggtcagaggctgagtaccagatgtgcgattcccagcggcccgtcctcctgtagaaggtgacgcccctgtactgcgagctccgcgacctaggcccgcgcctggtcttcttcgctggcgccaccggcctctgggccatgccgagatcctcggcgcgctgcggctgccacaccggcaccggcgccgccaccggctccggctccggctcggccggcggggtcggggacgggaagagctgccgcgtcatgaaccccgtggacgcgccaggcgccatctcaccggagcagtc

SEQ ID NO: 977 - DNA, 890 bp, Zea mays
catatatcttgggctattcgacagcgaagtagaggctgcaagggcgtacgacaaggccgcgatcaaatgcaacggtagagaggccgtgacgaacttcgagcccagcacgtacgacggggagctgctgctgactgctgaagctagcgcagaagttgctgacgacgttgatctgaacttgagcatctcgcaaccggcatcgtcccagagccccaaaagagacaagaactgccttggtccgcagctccaccaccaccatgggcggccgtttgacggctccgccgttctgaagaaaaccaagatcgatgctccgtctgagctgtcgtcggcgggccgccctcaccggtcgttcctccctcatctcgtggctgccgagcatctaccgcctcggtctcaccccttcttcatcacacaccatgagagtgatgcatcaagaagagatcctagctgggcagcagcagcagcatggaaggtgaccgcagctgcacctcctcctcctaccaccaccctgttgccgttgccgctgccgtcgacgtcgtccgctgcagcatcatcaggattctccaataccgccacgacagctgccgccgccccatcggccgcctcctcccgccggttcgacccgccgccaccgtcgtcgtcctcctcctcgagccatcaccaccaccaccaccgccgctgagaatcgaagaagccacactgtaaatctgccgggaagcggctggtggcatccggcccgctcctccctccggggcgccgcaacttttttcgatcggttttgcgccgcctgggacgggttgtagttgatcgattggattcttcataactgtatttgcgtactgcttacactacgacccaagtgaaatcgaaaatggtgccttctctcgttgaat

SEQ ID NO: 978 - DNA, 2285 bp, Zea mays
ggatctttcgctttccttaccccgttagcgttcctgcttgatacactacgactgcagattctttggcagaccgctaccaagtgcaagtgtgcaacgcacacacatcactcacagtctcacggtgtctctgtgcgcgcgcgtgggacacaggagggagagagacacagagaagggggcgggacgatcagctctagctcagctggtatcgtctaaactgcataaaaggggagggaaaaaaagttgcaatgatgcatcccggcgcatagatagagagagagagagaagagagagccccgactcgagagccaagaacgccgtgtgttgtgtttgtgtgcatctatctccgtacacgcacgctcgtacgcaccagctagcacgaccgccatggccgccaccaggagagccttcttccacagcgccgtcgacggcattgcgcgcgccgggccgggggaggccgagcggctgccggcgccgccgcaggtcgggcgaccggtggaaggcgccagcagcatggtcttgggcttccccgtgccgcggcccacgatgccggaccgccggccggccgccgtcacccagcagttctttccgcccactactacggccgcgcagcaggcgacgatggaggagcaatgccacgtgcccgccggtagcgcggcggagcagtgggtccggtcgtcggcgtccaggaagagccggcgcggcccgcggtcacggagctcgcagtaccgcggcgtcaccttctaccgccgcaccggccgctgggagtcccacatctgggactgtgggaaacaggtgtacttgggtggattcgacacggcgcaggccgctgcgagggcctacgaccaagccgcgatcaagttccgcggcctgaacgcggacatcaacttcaccctggacgactacaaggacgagatgaagaagatgaaggacttgagcaaggaggagttcgtgttggtgctccggcggcagggcgccggcttcgtcaggggcagctccaggttccggggagtcacccagcacaagtgcggcaagtgggaggccaggatcggccagctcatgggcaagaagtatgtgtacctgggcctgtatgacacagagacggaggctgcccaggcatatgacaaggctgccatcaagtgctacggcaaggaggcggtgaccaacttcgatgcccagagctacgacaaggagctccagtcgcagccctgggacggcgagctggatctcgagctcagtctgggctgcgccagcagcgatccgtccacggtcgccgtcgaggcgttcagccccgcgacgagcagcagtagccgcaagcagaggacgatgacgctgacgctcggtctgccggaggaggaggagacgggcgccggctaccctcaccctgctgccggcatgttcgggcgcccggctgatggccacgtccacgtagcaccgccgccacaccggcaatggcagcagcagcagcagggacagcacgcagctccagatgcggcgcctgagcgacgagcggcagagccagcagatcggcagcggtggggccggggcgcgcgctggcccatcgccagcgccagcggcattaactgggcctgggcgccgccgtacgccaccgcccgcgccggcaccgacgacgacgacgccagcagcgccgccgctgcagcatcatcaggattcccactgtggcagctgggtgcggcgtcgtccaggtccagctggcccagctgctgagcctttcctgtcgtcccgcgccaccaacagtgacgctgctgggccacgtactgacggcgactggtgacctgctggaaccgccgccggcctgtttcccttttctaggtaaaagcagtggcagaggggcgagctagcgacagcgtgcctcgtcatccatcgtccctgcgccgtggctggcggggtgggaaaaagtctgagcagttttgagcgtccggaggagctcgagatttcctccctcgaatagtcacttggggtggccactagttattatttctttccttccccctcgttgattctgctacccattatagcctctgtatctagctacatgcatgatgctgctctagcgctgttggacgttgatggcacggtgtacggatatgggacagggttcgtgtgaccccatgtccactgctaggcctgtttccaaatggagtatttctgcagtaccatggcttatagaaatgccgagtattttaaaccattaggtgcttggttactttcccaaaaactaggttttcaaagctatggtataatgaataccacggtatatatttttc

SEQ ID NO: 979 - DNA, 441 bp, Zea mays
atgggatattggcaattcaatgccattgtcgtgagaatcagaattcacattcttcttgtcaaaggattgtggaagatgacgtctttaaactttttgtttggagtgtctagagtcgagctcattaagtggtcacttgatgttgctccattagtgttgatcaaaggagtattgatatgcaaattctttgtctgcaatgcaggctggaacatgaaatggaaacctgctttctgcagccactctgaagttggagtagctgttggagctatttggggtgagaatcctgatgatgctgccatttcgaccacaggaagatcaggactattggaatgcagttgcctagtccatcctgattgctgttccagtggcaaagagggtactacagttgacaaacccccaactcttttgtctttcaatccatcaacaagatttggtaccttgtaa

SEQ ID NO: 980 - DNA, 1338 bp, Zea mays
atggccgccaccaggagagccttcttccacagcgccgtcgacggcattgcgcgcgccgggccgggggaggccgagcggctgccggcgccgccgcaggtcgggcgaccggtggaaggcgccagcagcatggtcttgggcttccccgtgccgcggcccacgatgccggaccgccggccggccgccgtcacccagcagttctttccgcccactactacggccgcgcagcaggcgacgatggaggagcaatgccacgtgcccgccggtagcgcggcggagcagtgggtccggtcgtcggcgtccaggaagagccggcgcggcccgcggtcacggagctcgcagtaccgcggcgtcaccttctaccgccgcaccggccgctgggagtcccacatctgggactgtgggaaacaggtgtacttgggtggattcgacacggcgcaggccgctgcgagggcctacgaccaagccgcgatcaagttccgcggcctgaacgcggacatcaacttcaccctggacgactacaaggacgagatgaagaagatgaaggacttgagcaaggaggagttcgtgttggtgctccggcggcagggcgccggcttcgtcaggggcagctccaggttccggggagtcacccagcacaagtgcggcaagtgggaggccaggatcggccagctcatgggcaagaagtatgtgtacctgggcctgtatgacacagagacggaggctgcccaggcatatgacaaggctgccatcaagtgctacggcaaggaggcggtgaccaacttcgatgcccagagctacgacaaggagctccagtcgcagccctgggacggcgagctggatctcgagctcagtctgggctgcgccagcagcgatccgtccacggtcgccgtcgaggcgttcagccccgcgacgagcagcagtagccgcaagcagaggacgatgacgctgacgctcggtctgccggaggaggaggagacgggcgccggctaccctcaccctgctgccggcatgttcgggcgcccggctgatggccacgtccacgtagcaccgccgccacaccggcaatggcagcagcagcagcagggacagcacgcagctccagatgcggcgcctgagcgacgagcggcagagccagcagatcggcagcggtggggccggggcgcgcgctggcccatcgccagcgccagcggcattaactgggcctgggcgccgccgtacgccaccgcccgcgccggcaccgacgacgacgacgccagcagcgccgccgctgcagcatcatcaggattcccactgtggcagctgggtgcggcgtcgtccaggtccagctggcccagctgc

SEQ ID NO: 981 - DNA, 1119 bp, Zea mays
atggctgcaagaaagaaaaagcctttgcttattgcttgccaagcaaccagtgccagaataacaagatctcaggctgctgcaaatagtacaagatctgggctggctccttctgtaccagtacctctgaaaacggagcataaccatccagcgaaaaaaaagatgaaaagggaagcttcagatgaaaatgcttctgctgatgctggagcttcagctcctctgcctaaaaggcgtacagttctcaagaatgtaactaacataagctgtgctaaaatttccaaaaggtgcactgctgtgactgggctgaagttgggtccctcccagaaggctgggcagagcataaacaagcaatgcacaaacaagatctccatgcttctccctctggctgttggagggagttcacttgtggatgattctaataatgctgaagaaacacaaatggtagaccttttggcacagaaagagaagcagattgttttgcttaaggaggctcagccattacagaatactgaacaaaacaaaggcggtgcttgtgatgaggcatctgttgaggaaagaaatgccatgaatgtacacgaaactgctgccttaaaggctggggtctctaatggtttaaacattgtagatattgacaaaaataatggtgatcctcaaatgtgtgttacctacgttgcagagatatacagaaatctaatggcctcagaggtttcggacgaatataagcttgtggcagatacactttaccttacagtatatcttattgaccaatttctttctcagaactgtatccaaacgcacaagctgcaacttcttgggataactagtatgctgattgcctcgaaatatgaagagtattctgctcctagtgctgaagaattttgtaacataacggctggtacatatgcaaaggctgaggttctggaaatggagcaacaagtgcttaatgatctgggctttcatttatctgttccaacaacaaacacatttctcaggagattccttagagcagcacaggcttctcgtacagtaagatcagtacccaaaccacattgcaacgagtcctttcagtctatatgtattgtcctcaacactaagttggcaagctacatttccaggctcatc

SEQ ID NO: 982 - DNA, 1664 bp, Zea mays
aaagcaggctggtaccggtccggaattcccgggatggccgcccttttttttttttttttttttttcaacgtcaatcacttcagagagtttttttttaaaagaaccaaagactcctgtccccatccgcttaattatcaggctaacaacaacaacaacgacatccgctggctggcgctgctctgccgcttatagctgctccctgaaccccaggaggaagcacactagcttaacccccatcgatccgtgcagagcgccagcgagaacaacagcaaaattaagatgcaaaagcttgagaactactacagcaactagaacatcaactaaacctactgtaacaacgcagcaaacggacaagcagcaagagatctagtgaagaaagaacctgctggctagccaatgtgctgcgttctcacaggcctaatttctaagaagagaagctccgagtgagtgagtgtgagtgagtgagttcttggagcaaaaaccagtgacgtacacaaagcagcgagagatgtagagaaaccgaccgaccggccaaccaaccaaccaaccagccagtcaaaaagagtgcttcgctcccaaccttgctcctccattttgctgcagccatccgttgtcgtaggaagcagcagcaaagtaactacctgggcggtgcatgttgaggagctagctgacggtgatatatgtttgctgaattcatgcatggtatgctgctgaaatgctcgtgatggtggttggtggcatggtgggcgcgcggagtaatctgcgctccactgctctgccgtcgtcagtggtgagaagccgaggacacggacggcggcggcggcttgtcgccattgccgccgccgttgtgctcctcgtcgccctgcatcctggtggggatgcggatcccggagaagccgacgccgggcgagaacccgatggccgacacagcggggctgagcccgccgtgctgcatcgggttgtcggcttcgacgctctccggccatcctcgctcggagggctggttactggactgaaggggtcccctctggaagaagaactggctctggccgccaaacgccgcctgcatgtgcgccgcctgctgcgacacgttgaacaggtagccaccagcgctcccgccgcctgggtcgggcacggtccacggcaccatgcgctggctctgcgcctggtcgtgccacatggcgccgccgccaaacgagtagctggcggcgccggagaagagcgcctgctgcgccgagccattgccgccgtgggcttccgaccggtcctgctgctggtggaacatggggtctgggagagactgcagcgacagccggagctcctggctgtggcggccggtgcgcgacaggaggtcgggcgtgtagctttggaggcccatggccgacgactgcgccgccgccgtggacaacgacgcctcgccgccgccaccaacgccagccatgggaaagaacgacttgatcgtgtccggaacagagtcccgcccgagctacgccggctggggtcgggcggcgccgccgcttgctccaccggcgccggagaagtcgaacggagcgtgcgcggcgacggtgatggcctgcgcctggtcgtcggagttctcggcggagtcgatcccgggaattccggaccggtaccagcctgcttttttgtacaaacttgttctatag

SEQ ID NO: 983 - DNA, 618 bp, Zea mays
ttttttttttttttttgacccggaagctcagtagttcgatttacggctttcctcgctgtgggtaaatacagtgctgtcgccttataagaatctcgaatagatattctcacatcccaactagggtgcacattgtaggatctggcgtgtgatattttattgattatctcgctgcactgatcaatggtcatgctggttggatggagtgatctgtgctccactgctgctgtcactggtcattatacctaggaaacagatcgatgccgccgctgattgtctccattgtcgactccgctctgttgtgctcctcttcgccctggatcctggtggggatacggatcccagaaaagcctgcacctggtgcgattacgatggtttgcccaccatggtgtatcgggctgcctgcttcaaccgtctccgggcgacctcgctccaagtcagatggctggctactggactgaaggggtccccctctgaagaagaactggttctggcctcccagctcagtctgttgcgaccgctactcgttaagcatgcagacacgggggttaacaactgctgggcccgggcgaggtcgatggcccctccgcttggccctgcgcgttgctaggactcccgctg

SEQ ID NO: 984 - DNA, 1930 bp, Zea mays
gacactatagaacaagtttgtacaaaaaagcaggctggtaccggtccggaattcccgggatcccacactcccgaggggaaaaagaaagcgagaaagcttcgagctttgcctcccccgtccccccacccccacccccaagggtaaaatgtgatgttgccatccatccgaatccgagaatccgattgcttctagtttgtctccccaactcctcgcctcgcctctcctcctggttatgggcgccggcgagttggatggacgcgccttgtcggacgcggagcagcagtagcggcgggcaaccaggcgggggatctggatccgaggcaccaccaccgggctcctcacggcggcgacgcaggcggcggcggagaaggaggaggaggcggaggagcgcagcaagaagcagatgagcagcagcggcaccacaacaaccggctgctgcagttccaccagcaagtgcagcagaaccaagacccgccgccgagaactccgacgaccaggcgcaggccatcaccgtcgccgcgcacgctccgttcgacttctccggcgccggtggagcaagcggcggcgccgcgggcttcctcccggcgtcgctcgactcggactccatcgcggacacgatcaagtcgttctttcccatggctggcacgggtggcggcggcgaggcgtcgtcgtccacggcggcggcgcagtcgtcggccatgggcttccaaagctacacgcccgacctcctgtcgcgcaccggcagccacagccaggagggggggctgtcgctgcagtctctcccagaccccatgttccaccagcggtcgcacggccacggccacggcggcgatggctccgcgcagcaggcgctcttccccggcgccgccagctactcgttcggcggcggcgctgcgtgggccgagcacgcgcagagccagcgcgtggcgccgtggaacgcgcccgacccaggcggcgggagcactggcggctacctgctcaacgtgtcgcagtcgcagcaggcggcgcttggtggccagagccagttcttcttccagaggggaccccttcagtccagtaaccagccctccgactccgagcgaggatggccggagaccgtcgaagccgacaacccgatgcagcatggtgggccgaccatcgggttcgcgcccggtaccagcttctccgggatccgcatccccaccaggatacagggcggcgaggagcacaacggcggcagcggcaatggcgacaagccgccgccgcctccgtctgtttcctcggcttctcgccagtgacagcagcagtggagcacagattactccatccaaccagcatgaccattgatcagtgcagcgtgtatcactaaaatctcacacgccagctcctcaacgtgcacccttgttgtgatgtgagaatctctttcgtgattcttcttcgttgtagcactgtattttcccaccgcaggattgccgtttcttgtactactgagtttctggtgcagttctgttgtccccattccaggttagttaatttgctgcttcttcatacgacaacggatggctgcagcaaaatggaggagcaaggttgggagcgaagcactctttttgactggctggctggttggttggttggttggttggccggtcggtcggtttctctacatctctcgctgctttgtgtacgtcactggtttttgctccaagaacgaactcactcacactcactcactcggagcttctcttcttagaaattaggcatgtgagaacgcagcacattggctagccagcaggatctcttgctgcttgtccgtttgctgcgttgttacagtaggtttagttgatgttctagttgctttagtagatctcaagcaaatgcatcttaattttgctgttgttctcgctggcgctctgcacggatcgatgggggttagctagtgtgcttcctcctg

SEQ ID NO: 985 - DNA, 563 bp, Zea mays
tcggtttttttttttttttttttttttttttttttttttttttttttttttttttggaaaaaaaaaaataatatatggaatagggtaaaacggtagtagcagtagcaagaactaatgaaacagtaccggttgtctagtttcaagctagggaacggtttgattaaaccttatttacacaggcacacggtcgctcaaatatagccgcagcagcagcagctaataactaataaggcgaaaatcccatcacctaataaacaaactccttacctcgtagtcgtagttaagcacgtacgttaatcactttctcatcgtttcgcttccttgctcctcctggccctggacccgttggcccgcggccggcggcgcgaggaaccccatgaacccgccgccggcgccaaccaaatggttgaagccgacctgcccagccatcgccgacggttgttggtggatcgcggccaaagggtcgagccaagggcgggccgcaaacggccagccgccactggactgaaggggttccccttgggaaaagagctgcccgccctggtggtctagccccccttgcc

SEQ ID NO: 986 - DNA, 690 bp, Zea mays
ggtacgcgtaagctctgggcccctcgagggatactctagagcggccgccctttttttttttttttttttttttttttttttttttttttttttttttttgaagaagcagcaaattaactaacctggaatggggacaacagaactgccccaaaaactcagtagtacaagaaacggcaatcctggggggggaaaatacagtgctacaacgaaaaaaaatcacgaaagaaattctcacatcccaacaagggtgcacgttgaggagctggggggtgagattttagtgatacccgctgcactgatcaatggtcatgctggttggatggagtaatctgtgctcccctgctgctgtcactggcgaaaagccgaggaaacagacggaggggggggcggcttgtcgccattgccgctgccgccgttgtgctcctccccgccctgtatcctgggggggatgcggatcccggagaagctggtaccgggcgcgaacccgatggtcggcccaccatgctgcatcgggttgtcggcttcgacggtctccggccatcctccctcggagtcggagggctggttactggactgaaggggtcccctctggaaaaagaactggctctggccaccaagcgccgcctgctgcgactgcgacacgttgagcaggtagccgcccgtgctcccgccgcctgggtcggggcgcgt

SEQ ID NO: 987 - DNA, 710 bp, Zea mays
gaaagctgggtacgcgtaagcttgggcccctcgagggatactctagagcggccgcccttttttttttttttttttttttttttttttttttttttttttgcggggggaaaatacagtgctacaacgaaaaaaaatcacgaaagaaattctcccatcccaacaagggtgcacgttgaggagctggggtgggaaattttaatgataccccctgcactgatcaatgggcatgctggttggatggagtaatctgtgctcccctgctgctgtcactggcgaaaaacccaagaaacagaaggaggggggggcggcttgtcccccttgccgctgccgccgttgtgctccccccccccctgtatcctgggggggatgcggatcccggaaaaactggtaccgggcgcgaaccccatgggccgccccccatgctgcatcgggttgtcggcttccacggtctcccgccctcctccctcggaatcggagggctggttactggactgaaggggtcccctctggaaaaaaaactgggtctggccaccaagcgccgcctgctgcgactgcgacacgttgagcaggtagcccccagtgctccccccgcctgggtcgggcgcgttccacggcgccccgcgctggctctgcgcgtgctccgcccacgcagcgcccccccccaacgaatagctggcggcgcccgggaagaacgcctgctgcgcggaacc

SEQ ID NO: 988 - DNA, 2314 bp, Zea mays
aaagcaggctggtaccggtccggaattcccgggatcaccaccaccgttgtacaaaaaagcaggctggtaccggtccggcagtcactccagtcagcccctcctccctctacgctccccaaaaatcgcgcctcccgagttcgtccgcccgatcaaccgccgccctcgccagtcgccacgccagatctgacgacgacggacctcaccgccgcgccgatcgcttgctctcgtcccgtcccgcacgcaccctcattcgcacacccaccaccactccgattacttcgtacacgccctccgaattgcgcccgtccgggtgggaagccgacgccgcgggcggcaatgcggggcgtgccggccggggggacgtggtaggggtccgccgtcgccgccgccgccgcgatggaggtggaggccgtgggctgcgtcggcgcggggggcaagcgggcccgggcgaaaggcgcgggcgcggagccggagcctaagcgccgcgcggtggcgatggccgtgccgccgcccgccgccgcgccgtgggcgcagcagcaccctgcctcgcggatctaccgcgtctcccggggctccggcggcaaggaccgccacagcaaggtgtacacggccaagggcatccgggaccgccgcgtccgcctctccgtcgccaccgccatccagttctacgacctgcaggaccgcctcggctacgaccagcccagcaaggccatcgagtggctcatcagggccgccgccgacgccatcgacaagctcccctcgctcgacaccgccgcaggcttccccgcgcacccggcctccgccaaggaccacgccccgcctgctggtgacaacgacgaccaccaccaccagcagcagctcacgaggtccggatgcagcagcacgtccgagaccagcaagggctccgtcctctccctctcccgctccgagagccgggtcaaggcgcgggaccgcgccagggagcggagcgccgttgccagggacaaggacaaggaccccgccgctgactccaggcgcgccgcggctacaagctcagcgcaggcggcatccttcaccgagctgctcacggggatggctgcggccagcagcgccgcccccgccgaacacaagcaccaccagcagtcgttggtgtcctggcagccgccgaccgtctccgccaccaccgactacatcgggttcgcgcagccccggaagggcgggggacacgcggtggcgcacgcttttgcctcccccgctccccacctcggcaacattgcgtccatcgccatggccccggcgcagcactaccaccacttggccagcggtgccgtcactgtcgcctctggcggcggcgagccgcacgccgatatgacgcacttctcgttcttgcaggaccacttcatgcccgtccacgcgatgccggcgtcggctcccgccggagaatacaacctcaacttctccatgtcctcgggtcttttgggtgtcaacagtagggggacccttcagtccaattcgcagccgcatatctccggccaccatcaccaccaccaacagctccagaggctgtctactccactggacgctcccaacataccattcatgttcagctcggccgccgctgccgctgccgctgcggcggtcaccacgcccaccacggccgacggccagttcgccgcgttccagctctggaacgggttccagcacgcagacatgaaggagaagggcaagcactgatcgacacctgcccagcgcagtgcgctgctatctggatgggcgtggaaaggcgtcaaataatcgcagcctgtccctacaagcaccatccattattgcctgaagctgctgccatgattgcagtggggatggttcctccccccgaattcttggaagtagatcatccttatttcaggctatcacactgaagaacctcgtcgtccttactctggcaaataaccttccgcacttctttttctgcctgctgttgtactcatttcctggaggcgaggttttcgggggcatgatttgccagaccagagcgcccccgtcagaaatgtactgtgatcattcccactcgaaaactttgccggtggatgggttcggtttggcccccttgatcggctctctctcgagctttagtgatcagttagttagtttttatatccctgccatttgtatggttttcggttgtgtgttgcacgaggagtgggaggactccagtgcatgacgtgtgtgtgcaagtttgtgcccctgttgtgtactactggcatagtgagagttctcctcgtatgtaaattttatttttattgtttcacagtggttatctcgtgttgctccctac

SEQ ID NO: 989 - DNA, 1562 bp, Zea mays
atggaggcagcagccgtgggcgccggcgcgcccggccgctcccagcagcagggctccaagcgcggccgcggcggcgccgtgaggggcagcgaggcggaggcggcgtggggccagccgccgccgccgccgccgccgctgggcccgggggcggggtcccggatctaccgcgtgcgggctagcgggggcaaggaccggcacagcaaggtgtacacggccaagggcatccgcgaccgccgcgaccgcctcggcttcgaccagcccagcaaggccatcgaatggctcatcaacgccgccgccgccgccatcgacaagctcccggagctcgacccggccgccttcgccgccctccccgcgccgggcgacgcggatgccgccggcaaggacaagcagcagcaggggagcaagtccgcgggcagcagcacgtcggagacgagcaagggatccgagctctcgctctcgcgctccgacagccgcgggggcgcctccgcccgggacagggaggtcaccgtggccagcacctcggcgcaggccgcgtccttcaccgagctgctcaccggggtggcgtcggccggcgccattagcgccgccgagcacaggcagtcctggcatcaccagcccaacgtctccgcggccgccgccggctgcgtcggcattgcgcacaacgggaaaggtgcgcacgggctgtcgacgcacgccttttctggccctgccgccgccaagttcggcagcgcgcctccgttcggcctggttccggcgcagcccttcaacttcaccagccccatcgagatgcctcacttctcgctcggccaggacactctggcggcgtcctcggctgccgccggggactacagcctcggtttctccatgtccgtcaggtttcttgggtgccagtagggggacccttcagtccaattcgcagtcgaacttctcaggccatcatcaccaccagctccagaggctggatggcccgctcttgtttggtcacgttcacggtgcggcggtggcgcatcccgcatccgagaaccagctcacatcatccgcggcgttacagctgtgggacggtctccggcactccggcatgaaggagaagagcaaaaactgattgctcattcttcaacgaaaactgaaaccacatccagttgctgggaccggttcgggcatatatggattcatccttcggagctgctaccgtttgttgcggtgatgaccatcagattgccgcacacaaggctgctatggtggccatcgtcaaccatccaccaccatcaggcaccagccctgctgccgtcgatcaagcaatcctgtgctttcttttttttcccttcttctctcttccattcctttcctaggtgctgttgtacaaattttgtgggagatgagagtttaaacaggctgtttgtaagagtgtgctcggtagccgcggttcttagtgctccccgcgcctaactgctggtctagactattctggagtttgtatgaacaggtccatcggacaaccgttgtgctcatagtttctcttagcatatatatcccccaaaaaaaaaaaaaaaaaacccgcggcc

SEQ ID NO: 990 - DNA, 1817 bp, Zea mays
gccaccagcgcgcgcaggagcagcttggtgtggttctatctgcctgcccctgcctcctgcggacggagtccttgtgcttgtggacggtgtgggggagtgcggaagtgagttcgctcaagctggaggaggacaagaaccagttgtccaagggcttggacccttggagcaaccctaccgccgccaccagcaccctgcactacctgctccaggagaaggagagagcgcaggcgcatgagcagctccagatctatcaccagcaaggattcagctacctccagcaccgcgggaggcagcagcagcagcagcagcagcagcagccgccgagggctgcaggagctggcggtgatggcgtcagcagcggcgagtcgacgcccgtggacgccctggcgaccgcattcgggagcggccgcatcgtgcggtctgccgccgggcgcaaggaccgccacagcaaggtgtgcaccgcgcgcgggctgcgcgaccgccgtgtccgcctcgccgcgcacacggccatccggttctacgacgtgcaggaccggctaggctacgaccgccccagcaaagccgtcgactggctcatccgtaacgctaaggccgccatcgacgagctttcggccgaccgggaagaggggcagcctgccgcggaggcagcggatgccactactaccgagccggccgagcaggtgacctcgacgtcctacgggttcggcggcaaccccggtggcgccatcggtggtgtggccggctccttcatgccacattcggtcggtgccgatgacgtctccggctccggctccggctccggctccggcaacgtcaagtctttgttcccctcgtcgtcgacaacgagcactacccccacccaggacgagtacaggggctccccgccggaccttctgtcgcgcacgaccagcagcaaccagcctcaggagctttgcctcactctccagtctaccaataaccaccaccaccagcagcagcagcagcagcagatcttcagccatgtgtccccgaaccaccacggtagtatgatctccgttgcaggcgtccaaggctggccggaggcgcacggccagagaatgccgccgtggcatgctccagagaacagcggcgcgggagacgacgggcgcggggccgccggaaatggcgacagttacatgttcggcgtgcccggcccacggcaagggttagaccacctgcagggccagctgatcttctcccaaggggaaccccttcagtccagtggcggcggctggccgtcgtcgtctgcccgcgcttggctcgaccccctcgtcgcgatccaccagcaccagccgtcgacgatgtccgggcaggtcggcttcggtcatctggttggcggcgccggaagcgggtttatggggttcctcgcgccgccggcccagcggctgcagctgcagagcgaggacgagcaaggaagcgaagcaatgagggagtgatgagcgtgattagctactactgctgaggtacggtgtgcgagcttaccacgcactgctctccattgatctgctcagttatatgtcattgtcatttcatgtaggagtttgtttaggtgatggaatttcgcatcattaattattagctgctgcaatattcaatcatgcctctgtataagtcgtccttggaacctgacagcgttactgttacattagtggctactactacgtacttttgtttttttatttcattctttttttttccatttcatggttgtcaacatggataagatgtgtggtgatgatgagatagacgggacgagatgtgatctcgatggggtttcccctctttggaccaaaaaaaaa

SEQ ID NO: 991 - DNA, 1650 bp, Zea mays
  misc_feature (1622)..(1622): n is a, c, g, or t
  misc_feature (1644)..(1645): n is a, c, g, or t
cccagcaaggccatcgagtggctcatcagggccgccgccgacgccatcgacaagctcccctcgctcgacaccgccgcaggcttccccgcgcacccggcctccgccaaggaccacgccccgcctgctggtgacaacgacgaccaccaccaccagcagcagctcacgaggtccggatgcagcagcacgtccgagaccagcaagggctccgtcctctccctctcccgctccgagagccgggtcaaggcgcgggaccgcgccagggagcggagcgccgttgccagggacaaggacaaggaccccgccgctgactccaggcgcgccgcggctacaagctcagcgcaggcggcatccttcaccgagctgctcacggggatggctgcggccagcagcgccgcccccgccgaacacaagcaccaccagcagtcgttggtgtcctggcagccgccgtccgtctccgccaccaccgactacatcgggttcgcgcagccccggaagggcgggggacacgcgatggcgcacacttttgcctcccccgctccccacctcggcaacattgcgtccatcgccatggccccggcgcagcactaccaccacttggccagcggtgccgtcactgtcgcctctggcggcggcgagccgcacgccgatatgacgcacttctcgttcttgcaggaccacttcatgcccgtccacgcgatgccggcgtcggctcccgccggagaatacaacctcaacttctccatgtcctcgggtctttttcgggttaacagtagggggacccttcagtccaattcgcaaccgcacatctctggccaccaccaccaccaccaacagctccagaggctgtctactccactggacgctcccaacataccattcatgttcagctcggccgcggctgccgctgcggcggccaccacgcccaccacggccgagggccagttcgccgcgttccagctctggaacggtttccagcacgcagacatgaaggagaagggcaagaactgaccgacacctgcccatcgcggtgcagtgctatctggatggatgtgaaggcatcaaataattgcaacctgtccctgcaagcaccatttcattgctcgaagctgccataagtgcgttggggacgatgtttccccgaattattttggaagcagattcatccttcagacacttgtactctggtcatcactgaagaacctcatcgtccttactctgacgaccttctggacttcttttttccgcctgctgttgtactcgtttcctggaggtgagattctcggagcgtgatttgccagtgtgccctgtcagaaagccattgtaatcattcccattatgaactttaccaacgggtggagattcgattcggccccttgatcggcccgctctttcgagtttcggggatcagttatatccctggcatttttatggttctcggttgtgtgttgtacgagaaagtgagaggactcctatgaatggattgaactcatatgtgggcaactttgtgcccccctgttgtgtgctgaaatactggcataatgggagtctcagatgtaaatttgctttcttgttttgcagcaattatttcgtattgctctctgatttgtgaaaagctagcacanattgcggtcgatacatgctggnntatat

SEQ ID NO: 992 - DNA, 2058 bp, Zea mays
atggcggcggcgggcgtttctccggcatttctccttcgtttgctctcccgatgttcagatctgagcgggttttgtgtcgggcggctcaagttccagccgcggtcaagacctcgtctaccaagggacgcaatctcgcctcgcccgagcccggcctcgggcggggacagtagtcccagacgaattcacgcctcgcccgagggcctcctcaggcgtcacttcgccctttcactgaccgacctgataggaaaacagcgccgctcgcgctgctccgactgctgtgccacccaccggggtaagactgacaacagccgagttcagcctcgggggcaacaggaagctgcgcctcgcccgaccttaggcctcggcctcgggaggaggtctccgcctcgcccgaccccaggaagctccgcctcgcccgaccttaggcctcggcctcgaaaggaggtctccgcctcgcccgaccccaaggctcggactcagcttcggcctcgggaggaatcgcgtcctcgcccgaccccggcctcggcctcaggagaagtctccgcctcgcccgaccttgggctcggaccgaccgcgccacaggggatacatcattaccctaccctagctaactcaggctacgagggaacaagatcggcgtcccatctggctcgccccgggctcaagcacttctccgacgaccacgttatcgcgtacacatggctcaagcacttctccgacaaccacgttggcatggctgcaggcgtcgcagcaccggcccgagtactccgttgtcccgttgtccgctcccactccactccggcccagctgcgtgctgctcccgtgctccggcaccggcaggcggataagcccagcaggcaagcatgcaggagactaggagaggaggagagctcagctgcagcactgcacgcgcgctcccctccccttgctggccaaatcgatcggtccccttcaggctccaggctccggagcttgctttacttcagatttgcgcgattccccttccaaaaagaaccaatcggtttgctactagatcggtgcgcgaggctagactttttctgggaattcaaccggcgaatgggcagggacggcggccgcgtgcgcatgagccgcgtattggcaactggggatgagcgcggcatgggcgaggtagcaggcgtggagcgcgccgcctgcaagcgcccgcgcggcgcgctcgacggcggcgggtcggcgtcggcggccgcgtggccggcgtgccgggtggctcgcgccgcggccggcggcaaggaccgccacagcaaggtggtgacggcgcgggggctccgggaccgccgcgtccgcctctcggtgcccacggccatccagttctacgacatccaggaccgcctcggcgtcgaccagcccagcaaggccatcgagtggctcatccgcgccgccgccgccgccatcgacggcctcccgtcgctcgactgctccttcgtcttcccccacgccgccgcctctccgccgggcggcgctgccgacgacgccgagctcagcacctccgagaccagcaagagctccgttctctcgcttgccaacgccccggttgacaacaccgccgccaccgccgctcactctcagcaagccaatcacgcctacaacaacaacgccgccgccggtggtggcgcgttcgccgagctgatcctgcactgctccgccaacaacagcagcaagccaatgcagcagcacccgacgctcgcttactacgccacccagcccccgaacgctcactccgcgtcggccatgtccttcgagacgatgctgccccacttctccttccttcaggagcagtctcaccacgcaatcgccttcgaccggggcacacttcagtccaatgccgccgttgctgcgccgctgtggccgacgtctcagcatgcgtgcctgctgcagaggttcgccgcttctccagctgatgccaccggactgccgtcgttctttcttggaagcggtgctgctggtgcttctccggtggtgccggccaatgcagagccgaggcttcagctctgggacttcaagcaggaacggaagacctga

SEQ ID NO: 993 - DNA, 1998 bp, Zea mays
gcccctcgagggatactctagagcggccgccgcgacgatggaggtggaggccatgggcggcgccgggggcaagcggggcagggccaagggcgcgggcgcgggcgcgggcgccgagccggagccgaagcgacgcgcgatggcggtggccgtgcagccgcccgccgccgcgccgtgggcgcagcagcacccggcctcgcggatctgccgcgtctcccgggcctccggcggcaaggaccgccacagcaaggtgtacacggccaagggcatcagggaccgccgcgtccgcctctccgttgccaccgccatccagttctacgacctgcaggaccgcctcggctacgaccagcccagcaaggccatcgagtggctcatcagggccgctgccgaggccatcgacaagctcccctcgctcgacgccgccgcgggcttccccgcgcacccggcctccgccaaggaccacgccccgcctgtcggtgacgacgacgaccaccaccaccagcagcagcagcagctcacgaggtccggatgcagcagcacgtccgagaccagcaagggctccgtcctctccctctcccgctccgagagccgggtcaaggcgcgggagcgcgcaagggagcggaacaccgttgccagggacaaggaccccgccgccaacgacaccaccgccaccacctcggcgcaggcggcgtccttcaccgagctgcttacggggatggccgcggccagcgccgcccccgctcaacacaagcaccagctgcggcagtcgtcggtgtcctggcagccgacgattgtctccgccaccaccgactacatcgggttcgcgcagccccggaagggcggggggcacgcgatggcgcacgccttcgcctcccccgctcctcacctcggcaacattgcgtccatcgccatggccccagcgcagcacttcggcttggccagtggtgccgtcaccgtcgcctccgggggcggcggcgagccgcacgccgagatgacgcacttctcgttcttgcaggaccatttcatgcccgtccacgcggcaccggcgccggccccggcgtcggctcccgccggagaatacaacctcgacttctccatgtcctcgggtcttatgggtgtcaacactaggggggcccttcagtccaattcgcagccgcatatctccggccaccatcaccagcagcagcagctccagaggctgtctactccactggacgctcccaacatacccttcctgtacagctctgccgccgctgcagctgcggcggtcaccacgcccaccacggccgagggccagttcgccgcgttccagctttggaacggtttccagcacgcagacatgaaggagaagggcaagaactgaccgacacctgcccatcgcggtgcagtgctatttggatggatgtgaaggcatcaaataattgcaacctgtccctgcaagcaccattcattgcttgaagctgccataagtgcgttgtggacgatgtttccccgaattcttttggaagcagattcatccttcagacacttgtgctttggtcatcactgaagaacctcatcgtccttactctgacgaccttctggacttcttttttccacctgctgttgtactcgtttcctggaggtgagattctcggagcgtgatttgccagtgtgccctgtcagaaagccattgtaatcattcccattatgaactttaccaacgggtggagattcgattcggccccttgatcggcccgctctttcgagtttcggggatcagttatatccctggcatttttatggttttcggttgtgtgttgtacgagaaagtgagaggactcctatgaatggattgaactcatatgtgggcaactttgtgcccccctgttgtgtgctgaaatactggcataatgggagtttcagatgtaaaaaaaaaaaaaaaaaaaaaaaaaaaaaaaaaaagggcggccgctctagagtatccctcgaggggcccaagcttacgcgtacccagctttc

SEQ ID NO: 994 - DNA, 2172 bp, Zea mays
aaagcaggctggtaccggtccggaattcccgggatccagcaatcagcttctgccgcgccgcggccccccccccgtgtgcccggggtcggtgatacagtggcagcgagcttgcagccgagcagctagaaaaaagtccagtgtgccagcgcgtgccagagccggagaaaaatgctggcacgattgtaggagcacgggcgatgcactaggcgcgggcagcgtagggataagacagcagcacagcagccgggccgacggctggacgtggccggcgcgcatgaccagcaagcagcacgccggggagcaccagccgttgccgcattccagcagcgacaggcaccgagccgaaaatcgccaggcgccagcccacgccgccaggcctagtgctccctcataaaagcgtcgcattcctctcacggtcacggcactcgccgcgccagcagccagcctatgagcagcgcttgcggcggcggcggttgtagggaatggaggcagcagccgtgggcgacggcgcgccagcgggccgctcccatcagggcgccaagcgcgcgcgcggcggcgccgtgaagggcagcgagacggaagcggcggcgtggggtcagccgccgccgctcccgccgccgccgggcccgggggcggggtcccggatctaccgcgtgggggcgagcgggggcaaggaccgccacagcaaggtgtacacgaccaagggcatccgcgaccgccgcgtgcgccctgtcggcgcccaccgccatccagttctacgacctgcaggaccgcctcggcttcgaccagcccagcaaggccatcgaatggctcatcaacgccgccgcctccgccatcgagaagctcccggagctcgacccggccgccttcgccgcccttcccgcgccgggcggcgcggatgccgccggcaatgataagcagcagcagcaggggagcaagtccgcgggcagcagcacgtcggagacgagcaaggggtccgagctctcgctctcgcgctccgacggccgtgggggcgccgccgcgcaggacagggtggtcaccgtggccagcacctcggcgcaggccgcgtccttcaccgagctgctcaccggggtggcgtcggccggcgccattagcgccggcgagcacaggcagtcgtggcatcagcagcccaacgtctccgccgccgccggcgccgaccgcgtcggcattgcgcacaacgggaaaggcgcgcacgggctgtcgacggcgacgcacgccttttctggccccgccgccgccaagtttggcaatgcgcctccgttcggcctggtgccggcacagcctttagacttcaccatccccatcgagatgcctcacttctcgctcggtcaggacacttcggcggcgtcctcgtctggcgccggggactacagcctcagtttttccatgtcctcgggtttcttgggtgccaatagggggacccttcagtccaattcgcagtcgaacttctcaggccatcatcaccagcagctccagaggctggacggcccgctcttgtttggccacgcccacgccgcggcggcgatgcatcccgcatccgagaaccagctgaccgcatcggcggcgttacagctctgggacgggctccggcactccggcatgaaggagaagggcaggagctgattgcacattcttcaatagaaaaccgaagacgacgtcctattgctgggggccgttccggcaagaattctattgtggagctgctaccattttgttgcggtgacgacttgtcagatcgccgcacgcaaggctgctatggtcaccatatcaaccatccatcagcgatagctgctgccgttgatcaaacaatcctgtgccttcttatttctttttttctttcatttccgtcgttgatgctgttgtacagattttgtgggatatgagagtttaaacaagtagtcgtaggagtgctcggtaatcgcgagagttctagtggctccccgcgtctgactgctggtctacattattttgaggttttggatgaacaggtccactggacaagtgttgtggtccctgatggctcgttctaggtgtgatgggatgaatatttcgatatggaaagatgatccactcggtcaaaaaaaaaaaaaaaaacgagacgctcgaggtactatccctcgaggggcccaagcttacgcgtacccagctttc

SEQ ID NO: 995 - DNA, 1826 bp, Zea mays
gtgaactatagaacaagtttgtacaaaaaagcaggctggtacccggccggacccccccgcctctcctctcctctggcccgtggcctgggtcagtgtccatccctccctgtccctgcccaccacttcgtctgctctccatccctcatccgtccccatgccgcgcccgccgccgcctacttcttctccacttttttgactgtttttcctgccatcctagctatgggctccgccgaggcggatggaagcgcattgccggacgcggagcagcagtagcagcggcggccaagcaagcgggggatctggatccgaggttctaccatcgggctcctcacggcggcggcggcggagaaggaggcggagcgcagcaagacgcagatgagcagcggcggcaacaccaccggctgctgcagctccaccaacaagtgcagcaggaccaagacccaccaccggcccccctcttccagctccagcacctgcaggccgcggcggcggcggccgtgaggcagcggggcggcttgttgtccgccgggtatgcccttctcgcccccatgggcgacgctagccagtcccactcccactcccactcccaacaccacggcttccagccgcagctcctatccttcgggggagccggccagcaccacgcgcaccagttcacggcgcaggcggcgtcccacttgcggccacgaggacggggagcggtgggcgcgggcggcgaggccgtggccacgacgtccgcgtcgcgctcgcgcgtgaggggcggcggcggggaggccgtggcggtgcagggaggccacattgcgcgctccacggggcgcaaggacagccacagcaaggtgtgcacggcgcgcgggacgcgggaccggcgcgtgcggctggcggcgcacaccgccatccagttctacgacgtgcaggaccggctgggctacgaccgccccagcaaggccgtcgactggctcatcaagaacgccaaggacgccatcgacaggctcgagacgacgctgcccgcggccaatgccgcgccgccgtcctcctcctggacgcacccagactccgccgagaactccgacgaccaggcgcaggccatcaccgtcgcgcacacggccttcgacttccccggcgccgacggtttcctagttccggcgtcgctcgactcggacacgatcaagtcgttctttcccgtggctggcacgggaggcggcgaggccgaggcgtcttcgtccgcgacggcggcgcagtcgtcggccatggggtaccaaagctacacgcctgacctgctgtcccgcaccggcggacacagccaggagctgcggctgtcgctgcagtctctcccagaccccatgttccaccaccggtcgcacggccacggccacggcggcgatggctccgcgcagcaggcgctcttccccggcgccgccagctactcgttcggcggcggcgctgcgtgggccgagcacgcgcagagccagcgcgtggcgccgtggaacgcgcccgacccaggcggcgggagcactggcggctacctgctcaacgtgtcgcagtcgcagcaggcggcgcttggtggccagagccagttcttcttccagaggggaccccttcagtccagtaaccagccctccgactccgagcgaggatggccggagaccgtcgaagccgacaacccgatgcagcatggtgggccgaccatcgggttcgcgcccggtaccagcttctccgggatccgcatccccaccaggatacagggcggcgaggagcacaacggcggcagcggcaatggcgacaagccgccgccgcctccgtctgtttcctcggcttctcgccagtga

SEQ ID NO: 996 - DNA, 2032 bp, Zea mays
  misc_feature (1399)..(1443): n is a, c, g, or t
atgggcgacgccggccagtcccactcccaccaccaccaccacggcttccagccgcagctcctgtccttcggaggagtcggtcagcaccacatgcaccagttcacggcgcaggcgctcgcggcgtctcactcctcgcggccgcggataggaggggtgggcgcgggcggcgaggccgcggccgccacgtccgcgtcgcactcgcgcgcgaggggcggcgccggggagatcgtggccgtgcagggagggcacattgtgcgctccacggggcgcaaggaccgccacagcaaggtgtgcacggcgcgcgggccgcgggaccggcgcgtgcgcctctctgcgcacaccgccatccagttctacgacgtgcaggaccggctgggctacgaccgccccagcaaggccgtcgactggctcatcaagaacgccaaggacgccatcgacaagctcgagacgctgcccgcgtggcagcccacggccaatgccgccgcgccaccgtcctcctcgacgcaccccgactccgccgagaactccgacgaccaggcgcaggccatcaccgtcgccgcgcacgctccgttcgacttctccggcgccggtggagcaagcggcggcgccgcgggcttcctcccggcgtcgctcgactcggactccatcgcggacacgatcaagtcgttctttcccatggctggcacgggtggcggcggcgaggcgtcgtcgtccacggcggcggcgcagtcgtcggccatgggcttccaaagctacacgcccgacctcctgtcgcgcaccggcagccacagccaggagctccggctgtcgctgcagtctctcccagaccccatgttccaccagcagcaggaccggtcggaagcccacggcggcaatggctcggcgcagcaggcgctcttctccggcgccgccagctactcgtttggcggcggcgccatgtggggcgagcaggcgcagagccagcgcatggtgccgtggaccgtgcccgacccaggcggcgggagcgctggcggctacctgtttcacgtgtcgcagcaggcggcgcacatgcaggcggcgtttggcggccagagccagttcttcttccagaggggaccccttcagtccagtaaccagccctccgagcgaggatggccggagagcgtcgaagccgacaacccgatgcagcacggcgggctcagccccgctgtgtcggccatcgggttctcgcccggcgtcggcttctccgggatccgcatccccaccaggatgcagggcgacgaggagcacaacggcggcggcaatggcgacaagccgccgctcgtcgtccgtgtcctcggcttctcaccactgacgacggcagagcagtggagcgcagattactccgcgcgcccaacatgccaccaaccaccatcacgannnnnnnnnnnnnnnnnnnnnnnnnnnnnnnnnnnnnnnnnnnnncaccgtcagctagctcctcaacatgcaccgcccaggtagttactttgctgctgcttcctacgacaacggatggctgcagcaaaatggaggagcaaggttgggagcgaagcactctttttgactggctggctggttggttggttggttggttggccggtcggtcggtttctttacatctctcgctgctttgtgtacgtcattggtttttgctccaagaacgaactcactcacactcactcactcggagcttcttttcttagaaattaggcatgtgagaacgcagcacattggctagccagcaggatttcttgctgcttgtccgtttgctgcgttgttacagtaggtttagttgatgttctagttgctttagtagttctcaagcttttgcattttaattttgctgttgttctcgctggcgctttgcacggatcgatgggggttagctagtgtgcttcctcctggggttcagggaggagctataagcggcagagcagtgccagccagcggatgttgttgttgttagcctgataattaagcggatggggacaggagtctttggatggttaaaataatctctctgatgtgattg

SEQ ID NO: 997 - DNA, 1359 bp, Zea mays
atggaatcgcctcaatcatttccggcggaaccctttgtgcgttatcgtctcctcttctttactgaaaaggctgcaggcgtcgcagcaccggcccgagtactccgctgtccgctcccactccactccggcccagctgcgtgctgctccggcaccggcaggcggataagcccagcaggtaaagcaggcaggagaggaggagagctcagcactgcacgcgcgctcccctccccttcccttgctggccaaatcgatcggtccccttcaggctccaggctccggagcttgctttacttcagatttgcgcgattccccttccaaaaagaaccaatcggtttgctactagatcggtgcgcgaggctagactttttctgggaattcaaccggcgaatgggcagggacggcggccgcgtgcgcatgagccgcgtattggcaactggggatgagcgcggcatgggcgaggtagcaggcgtggagcgcgccgcctgcaagcgcccgcgcggcgcgctcgacggcggcgggtcggggtctgcggccgcgtggccggcgtgccgggtggcgcgcgccgcggccggcggcaaggaccgccacagtaaggtggtgacggcgcgggggctccgggaccgccgcgtccgcctctcggtgcccacggccatccagttctacgacatccaggaccgcctcggcgtcgaccagcccagcaaggccatcgagtggctcatccgcgccgccgccgccgccatcgacggcctcccgtcgctcgactgctccttcgtcttcccccacgccgccgcatctccgccgggcggcgctgccgacgacgccgagctcagcacctccgagaccagcaagagctccgttctctcgcttgccaacgccccggttgacaacaccgccgctcactctcagcaagacagtcacgcctacaacaacaacgccgccgccggtggtggcgcgttcgccgacctgatcctgcactgctccgccaacaacagcagcaagccagtgcagcagcagccgacgctcgcttactacgccacccagcccccgaacgcgcactccgcgtcggccatatccttcgagacgatgctgccccacttctccttccttcaggagcagcctcaccacgcaatcgccttcgaccggggcacacttcagtccaatgccgccgttgctgcgccgctgtggccgacgtctcagcatgcgtgcctgctgcagaggttcgccgcttctccagctgatgccaccggactgccgtcgttctttcttggaagcggtgctgctggtgcttctccggtggtgccggccaatgcagagccgaggcttcagctctgggacttcaagcaggaacggaagacctga

SEQ ID NO: 998 - DNA, 1474 bp, Zea mays
gccagcctatgagcagcgcttgcggcggcggcggttgtagggaatggaggcagcagccgtgggcgacggcgcgccagcgggccgctcccatcagggcgcctgtcggcgcccaccgccatccagttctacgacctgcaggaccgcctcggcttcgaccagcccagcaaggccatcgaatggctcatcaacgccgccgcctccgccatcgagaagctcccggagctcgacccggccgccttcgccgcccttcccgcgccgggcggcgcggatgccgccggcaatgataagcagcagcagcaggggagcaagtccgcgggcagcagcacgtcggagacgagcaaggggtccgagctctcgctctcgcgctccgacggccgtgggggcgccgccgcgcaggacagggtggtcaccgtggccagcacctcggcgcaggccgcgtccttcaccgagctgctcaccggggtggcgtcggccggcgccattagcgccggcgaacataggcagtcgtggcatcagcagcccaacgtctccgccggcgccggcgccgaccgcgtcggcattgcgcacaacgggaaaggcgcgcacgggctgtcgacggcgacgcacgccttttctggccccgccgccgccaagtttggcaatgcgcctccgttcggcctggtgccggcacagcctttcgacttcaccatccccatcgagatgcctcacttctcgctcggtcaggacacttcggcggcgtcctcgtctggcgccggggactacagcctcagtttttccatgtcctcgggtttcttgggtgccaatagggggacccttcagtccaattcgcagtcgaacttctcaggccatcatcaccagcagctccagaggctggacggcccgctcttgtttggccacgcccacgccgcggcggcgatgcatcccgcatccgagaaccagctgaccgcatcggcggcgttacagctctgggacggactccggcactccggcatgaaggagaagggcaggagctgattgcatattcttcaatagaaaaccgaagacgtcctattgctgggggccgttccggcaagaattctcttgtggagctgctaccattttgttgcggtgacgacttgtcagatcgccgcacgcaaggctgctatggtcaccatatcaaccatccatcagcgatagctggtgccgttgatcaaacaatcctgtgccttcttttttctttcatttccgtcgttgatgctgttgtacagattttgtgggagatgagagtttaaacaagtcgtcgtaggagtgctcggtaatcgcgagagttctagtggctccccgcgtctgactgctggtctacattattttgaggttttggatgaacaggtccactggacaagcgttgtggtcaaaaaaaaaaaaaaaaaaaaaaaaagggcggccgctctagagtatccctcgaggggcccaagcttacgcgtacccagctttc

SEQ ID NO: 999 - DNA, 1275 bp, Zea mays
ctagaaaaaagacgccagtccaccaccgcttcccgtgcagcgccctccctatacgttcccccatttcctgtgttggcggcgatggcgcggcacttcgtgctcaacaccggcgccaagatcccctccgtggggctcggcacctggcagtctgaccccggcgtcgttggcaacgctgtctacgccgccgtcaaggcgggttaccgacatatcgattgtgccagagtttacggcaacgaaaaggagattggtttggcgctgaagaagctatttgaagagggtgtagtgaagcgagaagatatgtttatcacctctaagctatggaatgatcatcatgctcctgaagatgtgcctgaggcactaaatgacagcctgaatgatttgcagcttgagtacctggatctttatcttatccattggccatttagagtcaagaagggaacaaataccagccctgaaaattttgttacacctgacttccctgctacttggggggcaatggaaaagttatatgatgctggcaaagctcgcgctattggtcaaactaagctccatagcttttgtcagtcaactggtgttcatctaactgcttactcaccactaggttcacctggtacaacttggatgaatggtaatgtccttaaagaaccaataatcatctcaatagctgagaaactcgggaaaacttctgcacaagtggctctgcgctggaacattcagatgggtcacagtgttcttccaaagagcacgaatgaagaaaggataaagcaaaaccttgatgtttatgattggtcaattccagatgacttgcttgcaaagttctctgagattaagcaggctaggctacttagaggcaacttcattgttaatccagagagcgtttacaagacccatgaggagctctgggatggtgaactttaagaaggacgccgttgtccctcctgactcctgagcagggagcaagcagcgttccattagggctcgttagatcatttcacctccaaagttgctcttttgaaatgaaggttcagtgctcggaagctctggtgccatcctgtatcacgaactattgagaaatttgtcggtgattttactttgtgctacgggatgtgctgctgcagtctatcctagtgtcagttgattttttctggtaaaactgtgaccaaataagttaattcgccaggcatcattactattggaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1000 - DNA, 779 bp, Zea mays
aacgaagcaaaccagctcggaaacagagcagagagagagagagagaaaccagcagcgaatcccacacaggatccgccttcccttccttttcctacccccgatcgaaacagagagctagctagagagatagatattcccgcgaatcttctgctccgattccaagcccgtcccggtctcggtcccgtcccacgccccctccctccgccttcaatccttcttcatcggtaccagagcacccctgcggcggcggcagttcgagtcgaatcgctcctcctccttcgtcttcgtcaggcatgtgcgtggagggattcgaggacgcgcagatcgagaggccggcagatttcgcgatggagagagtctgtgagaacacagtgtccattgatttcaagcaagccaagatggtgactgcgatgggagaaagttggcacaattttgttccagctatccgctcaggggattggtctgacattggtggccgtgattacatggaagatccgcatgtgtgcatccccaacctagccaagaattttggttacaacatggtgggatgatgaagttatttccttctatggggtatttgatggacatggtggaaaagatgccgcacagtatgttcgcgacaacttgccgcgggtcatcgtggaagatgctgcttttcctcttgagcttgagaaggcagtcaggaggtcgtttatgcaaactgacagtcagtttgcagagaagtgctctctccaggatgggccttcttctggaacaactgcacttacagcaatgaattt

SEQ ID NO: 1001 - DNA, 1492 bp, Zea mays
caccgcttcccgtgcagcgccctccctctacgttcccccatttcctgtgttggcggcgatggcgcggcacttcgtgctcaacaccggcgccaagatcccctccgtggggctcggcacctggcagtctgaccccggcgtcgttggcaacgctgtctacgccgccgtcaaggcgggttaccgacatatcgattgtgccagagtttacggcaacgaaaaggagattggtttggcgctgaagaagctatttgaagagggtgtagtgaagcgagaagatctgtttatcacctctaagctatggaatgatcatcatgctcctgaagatgtgcctgaggcactaaatgacagcctgaatgatttgcagcttgagtacctggatctttatcttatccattggccatttagagtcaagaagggaacaaataccagccctgaaaattttgttacacctgacttccctgctacttggggggcaatggaaaagttatatgatgctggcaaagctcgcgctattggtgtgagtaacttctcctcaaagaaattgggtgacttgcttgctgtagctcgtgtacctccagctgttgatcaggtggaatgtcatcctggttggcagcaaactaagctccatagcttttgtcagtcaactggtgttcatctaactgcttactcaccactaggttcacctggtacaacttggatgaatggtaatgtccttaaagaaccaataatcatctcaatagctgagaaactcgggaaaacttctgcacaagtggctctgcgctggaacattcagatgggtcacagtgttcttccaaagagcacgaatgaagaaaggataaagcaaaaccttgatgtttatgattggtcaattccagatgacttgcttgcaaagttctctgagattaagcaggctaggctacttagaggcaacttcattgttaatccagagagcgtttacaagacccatgaggagctctgggatggtgaactttaagaaggacgccgttgtccctcctgactcctgagcagggagcaagcagcgttccattagggctcgtcagatcatttcacctccaaagttgctcttttgaaatgaaggttcagtgctcggaagctctggtgccatcctgtatcacgaactattgagaaatttgtcggtgattttactttgtgctacgggatgtgctgctgcagtctgtcctagtgtcagttgatttttctggtaaaactgtgaccaaataagttaattcgccaggcatcattactattggaatttcatcgttttatctcctcactatttttttatgctccatgtattctctatgatgagaccctgttgagtagttcactcatatagggggcgtttggtttctaggactaatgtttagtccctccattttattttaaaaaaaaaaaaaaaaaaaaaaaaaaaaaaaaaaaaaaaagggcggccgctctagagtatccctcgaggggcccgaagcttacgcgtacc

SEQ ID NO: 1002 - DNA, 1587 bp, Zea mays
gtccaccaccgcttcccgtgcagcgccctccctatacgttcccccatttcctgtgttggcggcgatggcgcggcacttcgtgctcaacaccggcgccaagatcccctccgtggggctcggcacctggcagtctgaccccggcgtcgttggcaacgctgtctacgccgccgtcaaggtccgcacaaacccgcgcccgcgtcctgttttcttctccctccgttgactatccagattgcattcttttttctcctccctcctttatactaatccctttatgaatcctgtttcctgggatacgggagatctttcttccccgaggaatttcacatgattgcgtacggatcttgcaggcgggttaccgacatatcgattgtgccagagtttacggcaacgaaaaggagattggtttggcgctgaagaagctatttgaagagggtgtagtgaagcgagaagatatgtttatcacctctaagctatggaatgatcatcatgctcctgaagatgtgcctgaggcactaaatgacagcctgaatgatttgcagcttgagtacctggatctttatcttatccattggccatttagagtcaagaagggaacaaataccagccctgaaaattttgttacacctgacttccctgctacttggggggcaatggaaaagttatatgatgctggcaaagctcgcgctattggtgtgagtaacttctcctcaaagaaattgggtgatttgcttgctgtagctcgtgtacctccagctgttgatcaggtggaatgtcatcctggttggcagcaaactaagctccatagcttttgtcagtcaactggtgttcatctaactgcttactcaccactaggttcacctggtacaacttggatgaatggtaatgtccttaaagaaccaataatcatctcaatagctgagaaactcgggaaaacttctgcacaagtggctctgcgctggaacattcagatgggtcacagtgttcttccaaagagcacgaatgaagaaaggataaagcaaaaccttgatgtttatgattggtcaattccagatgacttgcttgcaaagttctctgagattaagcaggctaggctacttagaggcaacttcattgttaatccagagagcgtttacaagacccatgaggagctctgggatggtgaactttaagaaggacgccgttgtccctcctgactcctgagcagggagcaagcagcgttccattagggctcgttagatcatttcacctccaaagttgctcttttgaaatgaaggttcagtgctcggaagctctggtgccatcctgtatcacgaactattgagaaatttgtcggtgattttactttgtgctacgggatgtgctgctgcagtctatcctagtgtcagttgattttttctggtaaaactgtgaccaaataagttaattcgccaggcatcattactattggaatttcatcgttttatctcctcactattttttatgctccatgtattctctatgatgagaccatgttgagtagttcactcatatagtcacacaaaacactgttttacattatcaacagagtaagctgctgaacgtgct

SEQ ID NO: 1003 - DNA, 1770 bp, Zea mays
atgggccgcggcggcgcgcgcgcggcccccgccgccgcggtgccgccctggcacgcgctcccggacgaggtctgggagcacgccttctccttcctccccgcggactcggaccggggcgccgccgcgtgcgcctgccacgcctggctccgcttcgagcgccgctcgcgccgccgccttgccgtcgccaactgctacgccgcgtccccgcgcgacgccgtcgagcgcttccccgccgtccgcgccgtcgaggtcaagggcaagccccacttcgccgacttcggcctcgttccgcccgcctggggcgccgacgccgcgccctgggtcgccgccgccgccgccggctggccgctgctcgaggagattagctttaagcgcatggtcgtcaccgacgactgcctcgagatgatcgcggcctccttcaggaacttccaggtgctgcgcctcgtctcctgcgagggcttcagtacagccggcctcgctgccattgccgctgcttgcagaaatctaagagaacttgaccttcaggagaatgagattgaggattgctctattcattggctcagtctatttccagtatctttcacttctttggtaactctaaatttttcatgcctagagggggatgtcaatatcactgtacttgaacaattagtaaccagatgcagcaacctcaagactctcaagctcaacaatgctatacctcttgacaagcttgctaacctccttcgcaaggctcctcagattgtagaactcggaacaggaagattctctgcagattaccatccggatctcttttcgaagcttgaagcagcatttgctggctgtaaaagcttaagaaggctctctggggcttgggatgccgttccagaatacctgccagcattttattgtgtatgcgaaggcctcacatcactaaatctgagctatgctactgtacgaggccctgaactgattaaattcattagcagatgcaaaaatttgcaactcttatgggtgatggacttgattgaagaccatggtcttgctgttgtggcatcgtcttgtaacaaactgcaggagttgcgggttttcccttctgctcctttcgaagcagctgagcaggtctctttgactgaaagaggtcttgttgatgtatctgccagttgcccaatgctggagtcagtcctctacttttgcagacggatgaccaacgaggcccttattaccatcgcgaagaaccggcccaacttcacttgcttccgcctatgcatcattgagcctcacacaccagattacattacacaccagcctcttgatgcaggttttagtgccattgtggaatcatgcaagggcctcaggcggctttctgtttcaggccttctcacggacagtgtatttaaatccatcggggcacatgctgaccgtcttgagatgctctcgattgccttcgccgggaacagtgatttgggcctccattacatcctatcgggctgcaagagcttgaagaagctagagattagggactgcccatttggtgacaagcccttgctggcaaacgctgccaagctggagacaatgcgatccctttggatgtcgacgtgctcaatgaccttgggcgcatgccggcagcttgcgcgcaagatgccccgtcttagtgtggaggtcatgaatgatcctcgacggggattccccttggactctctaacagatgagagccctgttgagacgttgtatgtctaccggacaatttcaggtccaaggtccgacacaccagcttgtgtccagattctc

SEQ ID NO: 1004 - DNA, 1770 bp, Zea mays; identical to SEQ ID NO: 1003

SEQ ID NO: 1005 - DNA, 2413 bp, Zea mays
gcaggagacagaggggctccccccccacccccgagcccaaacgcagctagctccccattccacccaagctcccgcagccagatgctctcccccgctcgagccccaccgccgccgcccgtccccgccgccgggtagaccgcccgatccgacggcgcccgccgcacccatgggccgcggcggcgcgcgcgcggcccccgccgccgcggtgccgccctggcacgcgctcccggacgaggtctgggagcacgccttctccttcctccccgcggactcggaccggggcgccgccgcgtgcgcctgccacgcctggctccgcttcgagcgccgctcgcgccgccgccttgccgtcgccaactgctacgccgcgtccccgcgcgacgccgtcgagcgcttccccgccgtccgcgccgtcgaggtcaagggcaagccccacttcgccgacttcggcctcgttccgcccgcctggggcgccgacgccgcgccctgggtcgccgccgccgccgccggctggccgctgctcgaggagattagctttaagcgcatggtcgtcaccgacgactgcctcgagatgatcgcggcctccttcaggaacttccaggtgctgcgcctcgtctcctgcgagggcttcagtacagccggcctcgctgccattgccgctgcttgcagaaatctaagagaacttgaccttcaggagaatgagattgaggattgctctattcattggctcagtctatttccagtatctttcacttctttggtaactctaaatttttcatgcctagagggggatgtcaatatcactgtacttgaacaattagtaaccagatgcagcaacctcaagactctcaagctcaacaatgctatacctcttgacaagcttgctaacctccttcgcaaggctcctcagattgtagaactcggaacaggaagattctctgcagattaccatccggatctcttttcgaagcttgaagcagcatttgctggctgtaaaagcttaagaaggctctctggggcttgggatgccgttccagaatacctgccagcattttattgtgtatgcgaaggcctcacatcactaaatctgagctatgctactgtacgaggccctgaactgattaaattcattagcagatgcaaaaatttgcaactcttatgggtgatggacttgattgaagaccatggtcttgctgttgtggcatcgtcttgtaacaaactgcaggagttgcgggttttcccttctgctcctttcgaagcagctgagcaggtctctttgactgaaagaggtcttgttgatgtatctgccagttgcccaatgctggagtcagtcctctacttttgcagacggatgaccaacgaggcccttattaccatcgcgaagaaccggcccaacttcacttgcttccgcctatgcatcattgagcctcacacaccagattacattacacaccagcctcttgatgcaggttttagtgccattgtggaatcatgcaagggcctcaggcggctttctgtttcaggccttctcacggacagtgtatttaaatccatcggggcacatgctgaccgtcttgagatgctctcgattgccttcgccgggaacagtgatttgggcctccattacatcctatcgggctgcaagagcttgaagaagctagagattagggactgcccatttggtgacaagcccttgctggcaaacgctgccaagctggagacaatgcgatccctttggatgtcgacgtgctcaatgaccttgggcgcatgccggcagcttgcgcgcaagatgccccgtcttagtgtggaggtcatgaatgatcctcgacggggattccccttggactctctaacagatgagagccctgttgagacgttgtatgtctaccggacaatttcaggtccaaggtccgacacaccagcttgtgtccagattctctaaggggcagctgtggtctacaaaggtactatggaagcatccattttcaatcacatcatgtaccttcaacaccttactagcataacctggatcgtctccttgaagtagcaaggctggtgacctcggtaatcctgtcataatctctgcttagctgtacaactgtttctgggagtttagggtgagagactcagggtccctttcaggtgttaataactgtagggaggacactcgatgagttacaggaactactagatagcgtcttgaggaaacttgggtttgttttcttagcgtgcctagttcttttcatgtataaaaaaatatgggatcattccaatgctgccacaatgtactgtactattggaacaattgtacttggagcctctaaaaaaaaaaaaaaaaaaaaaaaaaaaaaaaaaaaaagggcggccgctctagagtatccctcgaggggcccaagcttacgcgtacccagctttc

SEQ ID NO: 1006 - DNA, 1578 bp, Zea mays
atgacctacttccccgaggaggtggtagagcacatcttcagcttcttgccatcgcacagcgaccggaacacggtctcccttgtgtgcaaggtgtggtatgaggtcgagaggctgagccgacgagcggtgttcgtagggaactgctacgctgtgcgccctgagcgtgtggtgctgcggttccccaatataaaggccctcacggtgaaggggaagcctcactttgcagacttcaaccttgtgccgcctgattggggtggctacgcagggccatggattgatgcagcagcaaggagctgtgttggtctcgaggagttgcgcatgaagcggatggttgtgtttgatgagaaccttgagctgctagctcggtcattcctgagattcaaagtccttgtccttatcagctgcgaggggtttagcaccgatggtctagctgctattgcgagtcactgcaagctcctgagggagttagatttgcaggaaaatgatgtggaggaccgtgggcccagatggctttccttccctgattcctgcacttcgctggtctccttgaatttcgcttgcatcaaaggggaggtgaattctggtgcgttggagagacttgttgctaggtctccaaatctacgcagtttgaggttgaatcgttctgtttcagtagacacactctcaaagatactattgcgagccccaaatttggaagacttggggacaggcctaaacttgagttatactcccacactggattattctgatctagctaaaatggtcagccgctgtgtgaaactccagcgtctctgggtactggattgcatttcagataagggtttgcaagtggtggcctccagttgcaaggacctacaagaactcagggtgtttccatcagaattttatgttcctggtgcttctgcagtgacagaggagggacttgttgcaatatcgtcaggctgcccaaaactgacctctttgctgtatttctgtcaccagatgaccaatgaagcgctaattactgtagctaataactgcccaaatttcatcagatttagactctgtatccttgagccaaagaagccagatgccatgacaggccagccgttagatgaaggttttggtgcgattgtccgtgaatgcaaagggctaagacgtctgtcaatatcaggtcttctcacagacaaggttttcatgtatattggaaaacatgcaaaatacctcgaaatgctttctatagcatttgctggagatagtgataaggggatgatggacgtgatgaacgggtgcaagaatctgaggaagcttgagatcagagacagtccatttggcgatgttgcactcttgggaaatgttgccaagtatgagacaatgcgatccctttggatgtcttcatgcaatgtcacattaaaggggtgccaggtccttgcatcgaagatgccgatgctcaatgtggagatcatgaatgaactagatggaagtagtgaaatggagaaccatggagacctctctaaagtggacaagttatatgtttaccgcacaactgctggagcgagggatgatgcaccaaattttgttaagatcctacagagctag

SEQ ID NO: 1007 - DNA, 1502 bp, Zea mays
ctacccagcccgccgcagcggcgcgcccatcccggttccgcctcctgttcgcgcgcgccgcggcgcagcggcagcgcgactccgagccggcgccggctgccgaggagaggcggtcgctggccgtcagaacgggggagctgttcctggggctggcggcgctgctgctgcgcgggaccggggccgagcgtagcggtggggccgcggtggaggaggtggaggcgagggacggggtggtgtgggagcagcgcccccaggacgtggacgcggagcggcggcgacgggagctcactagcccaggtttcagcttctccgccgcggggctgctcttcccctaccacctcggcgccgcgcagtgcctcatggaccgcggatacatcaccgagacaactccgttagctggctcatcagctggtgccacaaagaagccagatgccatgacaggccagccgttagatgaaggttttggtgcaattgtccgtgagtgcaaaggtctaagacgtctgtcaatgtcgggccttctcacagacagggttttcatgtttatcagaatgtatgcgaaataccttgagatgctttctatagcttttgctggagatggtgataaggggatgatggatgtgatgaacggatgcaagaatctgaggaagcttgagattagagacagtccatttggtgattttgcactcttgggaaatgttgccaaatatgacacaatgcgatccctttggatgtcatcatgcaatgtcacattaaaggggtgccaagtccttgcatcgaagatgccgatgctcaatgtggagatcatgaacgaactagatggaagtagtgaaatggagaaccatggtaacctctctaaagtggataagttatatgtttaccgtacaactgctggagtgagggatgatgcaccaaattttgttcaaatattatagagctagctgcaattaccttggtatcttcccttcctacgagaatcgggaaaagccacactggtttgtgcccttatcctggagcaacatggccgggattcatcatcatctctgtaccaactgctcccctcttccagtgtctggtcatatggccacccaggccctttatcgccttgtgcattctcactcgagaggaggacagaatcagatgacttttttttttcttcttttcacgccatgtaatctgtagtgtacctgtcttcatttgcttttcactttggcacggtggattgtgctgtcgcggtactgttctagtgttttgattcgtaaacctgagaactgtcgggacattccggtgacgatgatttctttcttgctcctgtgaatgcagtgtgtgtgcaaattttaggtttatactacatctctccacgtaaatttgctagatgtagccgactacccacgtagcggttcattaatgatcttggtttaattaatggctgagtattttttttctaatttatgtactttctctatttttgtttacatattttattatattaggtttattctgag

SEQ ID NO: 1008 - DNA, 1548 bp, Zea mays
atgggccgcggcggcgcgcgcgcggcccccgccgccgcggtgccgccctggcacgcgctcccggacgaggtctgggagcacgccttctccttcctccccgcggactcggaccggggcgccgccgcgtgcgcctgccacgcctggctccgcttcgagcgccgctcgcgccgccgccttgccgtcgccaactgctacgccgcgtccccgcgcgacgccgtcgagcgcttccccgccgtccgcgccgtcgaggtcaagggcaagccccacttcgccgacttcggcctcgttccgcccgcctggggcgccgacgccgcgccctgggtcgccgccgccgccgccggctggccgctgctcgaggagattagctttaagcgcatggtcgtcaccgacgactgcctcgagatgatcgcggcctccttcaggaacttccaggtgctgcgcctcgtctcctgcgagggcttcagtacagccggcctcgctgccattgccgctgcttgcagcaacctcaagactctcaagctcaacaatgctatacctcttgacaagcttgctaacctccttcgcaaggctcctcagattgtagaactcggaacaggaagattctctgcagattaccatccggatctcttttcgaagcttgaagcagcatttgctggctgtaaaagcttaagaaggctctctggggcttgggatgccgttccagaatacctgccagcattttattgtgtatgcgaaggcctcacatcactaaatctgagctatgctactgtgatggacttgattgaagaccatggtcttgctgttgtggcatcgtcttgtaacaaactgcaggagttgcgggttttcccttctgctcctttcgaagcagctgagcaggtctctttgactgaaagaggtcttgttgatgtatctgccagttgcccaatgctggagtcagtcctctacttttgcagacggatgaccaacgaggcccttattaccatcgcgaagaaccggcccaacttcacttgcttccgcctatgcatcattgagcctcacacaccagattacattacacaccagcctcttgatgcaggttttagtgccattgtggaatcatgcaagggcctcaggcggctttctgtttcaggccttctcacggacagtgtatttaaatccatcggggcacatgctgaccgtcttgagatgctctcgattgccttcgccgggaacagtgatttgggcctccattacatcctatcgggctgcaagagcttgaagaagctagagattagggactgcccatttggtgacaagcccttgctggcaaacgctgccaagctggagacaatgcgatccctttggatgtcgacgtgctcaatgaccttgggcgcatgccggcagcttgcgcgcaagatgccccgtcttagtgtggaggtcatgaatgatcctcgacggggattccccttggactctctaacagatgagagccctgttgagacgttgtatgtctaccggacaatttcaggtccaaggtccgacacaccagcttgtgtccagattctctaa

SEQ ID NO: 1009 - DNA, 443 bp, Zea mays
actctgtatccttgagccaaagaagccggatgccatgacaggccagccgttagatgaaggctttggtgcaattgtccgtgactgcaaaggtctaagacgactgtcaatgtcaggccttctcacagacagggttttcatgtatatcagaatgtatgcgaaataccttgagatgctttctatagcttttgctggagatggtgataaggggatgatggatgtgatgaacggatgcaagaatctgaggaagcttgagattagagacagtccatttggtgattttgcactcttgggaaatgttgccaaatatgacacaatgcgatccctttggatgtcatcatgcaatgtcacattaaaggggtgccaagtccttgcatcgaagatgccgatgctcaatgtggagatcatgaacgaactagatggaagtagtgaaatggagaaccatg

SEQ ID NO: 1010 - DNA, 2043 bp, Zea mays
ggcccctcgagggatactctagagccggtccaggtccatttagcgaggcggaaagggaggggggcgcgagcccagcggaagccccgaccccgaccccgaccgcgacccggaagaggaggaggaggaggaggaggaggaggaggagagagagagagagagagagggagagggagggacagacggggcgcggcgaggaggccggcgccggcggcccgcgctcgcggcgccggcgatgggggaggtggccgcgctgcgccagctcgtcggccaggttcaggagctctgggacctctacggcgccaacgcccaccccctgcccaggtggtatttacttgactttgaacatggttcaatcatggatgattattgtggaggaaggtctggatacaactcagaattactgaagatcatggaagctaaccaatctccccctcgcaagcgaccgcggagagatcgaaaccgtgaaaaggcaccctcctcaaacaagactgaagtaatgcaacaagagatctggagagatttccctgaagatctttttgaaactgtcattgcaaggcttccagttgctgcaatttttcgattccgcactgtctgccgaaagtggtcttctcttttgggctcagacagtttctctcatcagtactctgaagctccacgtgggctgccatggttctatacaatcacccatgagaacgcgaacaacaatgttgcaatgtatgatccttcgctgaagaaatggcaccacccatccgttcctctcactcctacaaagatagttattccagtggcatctgtgggtggccttgtatgtttattggatctgagccacaagaatttctacatttgcaaccctcttatgcaatcactcaaggagatcccaccaagatcagtccagggatggtcaagagtcgctgtagggatggtgttgaatggaagaagttctagtgatggctacaaagttatgtggtttggaaatgatgggacttttgaagtctatgactctacaaagaacatgtggtcttgccctggaacttttcctccaagcatcaaacttccacttgctctaaatttcaggtcacagcctgtggcggttggcagcacggtatacttcatgtgtgcagagccagatggtgttttgtcatatgatgtaagcactgggatttggaggcaatttgccatcccactgccaccgcatctgaccgaccacacacttgccgagttccagggaagggtcatgctggtgggtctgctgtgcaaaaatgcagcgacctgtgtctgcatttgggagttgcagaagatgactctcctctggaaggaggcggacagaatgccaaatatctggtgcttagagttctacggtaagcacatgaagatgacatgcctgggcaacagtggtttgctcatgctctccttgaaggcgaagcgtatgaaccgccttgttacatacaaccttctgaaaagggagtggcaaaaggttcctgattgcgtgctaccatacagccgcaaaaagcaatggatagcgtgtggcacagcatttgatccggtcccctgcgccttggcctgacatggaatttaccttctttgcccgagtaccataatactatagtgaattcgtatcattggcctatatttttagatctttctaatgttttatgatgagctctgcaaaaccgcgttcactgtggtttgttttctatcacgctgacgcatttgaaccgtttcctttgatcacctgctgctacttgggtcactgctacatcaattgggcaagtcgacctgagtatgtttcattgaagtaaaaaacggaacgccaggtgtctgtatttggtcttggttttggtatgtaccgtcaacttgtaatctttctgaacttgcagtttcctgtcctgaaccgagtttattatacaataaagaccgggatgttgacgttttgattctggtgcatggagattgtgtttcttgttattaccatgaaaacacatgtacatgtacttctgtttcaggctgcctactatttatcaatttatgtgcctacttttgatg

SEQ ID NO: 1011 - DNA, 1278 bp, Zea mays
atgtacgacaacatgaataaatcatgcattcagtcaagtgattctgtcaaaattattgacatgacactttcatacttctgtatgtatttttgtccaaaacaatgcttcgaatggtggtatttacctgacttcgaacatggttcaatcaaggatgattattgtgggggaagctcaggatacaactcggaattactgaagatcatggaaactaaccaatctcccccttgcaagcgaccgcggagagatcgaaaccgtgaaaaggcaccctcctcaaacaaaattgaagtcatggaacaagagatatggagagatttccctgaagatcttttcgaaactgtcatagcaaggcttcctgttgctgcaatttttcgattccgcactgtctgccgaaggtggtcttcccttttgggctcagacagtttctctcgtcagtactctgaagctccacatggactgccatggttctatacaatcactcatgagaattcaaacaacaatgttgcgatgtatgatcctttgctgaagaaatggcaccaccaatctgttcctctcaatcatacgaagatagttattccagtggcatccgtgggtggccttgtatgtttattggatctgagccacaggaatttttacatctgcaaccctcttacgcaatcactgaaggagatcccaccaagatcagtccatggttggtcaagagtcgttgtagggatggtgttgaatggaagaagttctagtgatggctacaaagtaatgtggttagatattgatgggacttgcgaagtttatgactctacaaagaacgtgtggtcttgccctggaacttttcctccaagcatcaaacttccacttgctctaaatttgaggtcacaaccagtggcggttggcagcatgatatacttcatgtgcgcagaaccagatggtgttttgtcatatgatggaagggttatgctggtgggtctgctgtgcaaaaatgcagcgacctgcatctgcatatgggagttgcagaagatgactctcctctggaaggaggtggacagaatgccaaatctctggtgcttagagttctacggtaagcacatgaagatgaaatgcctgggcaacagtggtttgctcatgctctccttgaaggcgaagcatatgaaccgccttgttacatacaaccttttgaaaagggagtggcagaaggttcctgattgcatgctaccatggagtcgaaaaaggcaatggataacatgtggcacagcatttgatccggtcccctgcgccttggtctga

SEQ ID NO: 1012 - DNA, 2773 bp, Zea mays
agaagatggaatcttctagagaatggtgaaaaatggaatttagaggtatataaagagaatccctccggttaatcattgatcacccaagccagtggagccttggcctcgaacagaatagaaccaaccaatcgcgcgggcgcacacagtcggcttccaccaaccacgttgccagcaggcagcggcagcctccacttgctccatgtctccatccaaccctcttccgccgccgggcgagacgcgcgtcggctgctcgttgccctcaccagtcacccctcaggccatgggcgggggccccgctcgtcatgtggccatgcgcgcccttcgcgctcgcttcctctcgcggcagcgggagggaggaccagcggcagcgtcgacctggtggtggtgcgcttcgggttcggcgaagggcgacatggagagcacgctcaaggggatacgcggcagcgatgcgccgtgcgttctggacctggacgacgcggccaccgtggcgggcggcgtcgaggacacctacggcgaggatcgcgccaccgaggagcagctcgtcacgccctggaccgtctccgtcgccagcggttacaatctgcttagggatccccgttacaacaagggacttgcgttcacagagagggaacgtgagacgcactacctccgtggccttctgccaccagctattgtatcccaggagctccaggaaagaaagatcatgaataatattcgacaataccagttgcctttgcagcgctacatggcactcatggatctccaggaagggaacgagaggcttttctacaagttgctcattgacaacgtcgaggagttacttccaatcgtgtacactccaaccgttggcgaggcctgccaaaagtatggatccatatttagtcgccctcagggtctttatatcagtttgaaggagaagggaaagatccttgaggtgttgaagaactggccagagaggagcattcaggttatagttgttactgatggtgaacgtattttggggcttggagatctcggatgccaggggatggggattcctgttggtaaactttccctttacactgccctgggaggagttcgtccatctgcttgcttgccgatcacattggatgttggtacaaataacgaggagctgcttaatgacgaattttacattggcttgagacaaagaagagccactggccaggagtacactgattttctgcaagaatttatgagtgctgtgaaacaaaactatggggagaaagtgcttattcagtttgaggattttgccaaccataatgcttttgatcttcttgcaagatatggcaccactcaccttgtattcaatgatgatattcagggaacagcttctgtggttcttgctgggcttattgcagcacaaacattacttggtggttcattggcagatcacacttaccttttccttggtgctggagaggctgggacaggtatcgctgaacttatagctcttgagatctcacgtcagacgaaagctcctatagaggagtgccgcaagaaaatctggcttgttgattcaaagggcttgattgtcagtacacgaaaggagtcccttcaacacttcaagaaaccatgggctcatgagcataaaccactcagcaacctcttagatgctgttaatgctatcaaaccaacagtgttgattggcacatccgggaaggggcaaactttcacaaaagacgttgttgaagcaatctcctcatttaacgagagaccaatcattcttgccctatcgaacccaacatcacaatctgaatgcacagctgagcaagcttacacatggagcaagggacaagcagtgtttgcgactgggagtccatttgatcctgtggagtacaatggcaagatacatgttcccggacaggcaaacaatgcctatatcttcccagggtttggcctcggcgtggtgatgtctggagctatccgcgttcatgatgacatgcttctggcagcatcggaggctctggcccagcaggtcacagaagaaaattttgagaaggggctgatttatcctcccttctcaaacataaggaagatctctgcccacattgcagccagcgttgcagcaaaggcatatgaacttggtttggcaagtaggcgccctcggccaaaggacctggtgaaatatgcagagagctgcatgtacagccccatctaccgcaactaccgttgaattcggatcaactccagttatgtgcaaatcagcagcagccttgcgtcaactgcaagatttcctaagaatataactcgtttcagtctttcatactgtaataccctaagccctctagcaatagctgtttcacgtccttttctgccccttacatattccgcagcgtttatctcttgcgatgtcatgtaaatcagctccggttaggcttttggatgctagtcagtcatggtgctgctgccgtccttccggttccggacaaggataaatttggaataaagtttgagtcgacgattcctcctcggtactgcgtgttatgaggacagattatcgtttgcttgagggggcagtggtcctcttttttgggtgctaaaatatatccatccgagtcagccggtccaagcctgttcccattttcaatgtaccagtcctgaagttccagataatcaggtggtaagatgttgtcggtgtttgtttgattgaacaggctatagctgcacgcctagactgtcacactttcggacgacccatattgtactgctgccagccccggtgaaataaaggctggtacacattggttcgggt

SEQ ID NO: 1013 - DNA, 2404 bp, Zea mays
atattcggcacgaggtaaagtcttagctaacgccagcagcagcagcagccccacgtctccgcatcgccgttaaataacatcgccatctcgcgttgctcccgcactaaccacgccatcacttctgttaactacattcgcagcggcagcgggagggaggaccagcggcagcgtcgacctggtggtggtgcgcttcgggttcggcgaagggcgacatggagagcacgctcaaggggatacgcggcagcgatgcgccgtgcgttctggacctggacgacgcggccaccgtggcgggcggcgtcgaggacacctacggcgaggatcgcgccaccgaggagcagctcgtcacgccctggaccgtctccgtcgccagcggttacaatctgcttagggatccccgttacaacaagggacttgcgttcacagagagggaacgtgagacgcactacctccgtggccttctgccaccagctattgtatcccaggagctccaggagagaaagatcatgaataatattcgacaataccagttgcctttgcagcgctacatggcactcatggatctccaggaagggaacgagaggcttttctacaagttgctcattgacaacgtcgaggagttacttccaatcgtgtacactccaaccgttggcgaggcctgccaaaagtatggatccatatttagtcgccctcagggtctttatattagtttgaaggagaagggaaagatccttgaggtgttgaagaactggccagagaggagcattcaggttatagttgttactgatggtgaacgtattttggggcttggagatctcggatgccaggggatggggattcctgttggtaaactttccctttacactgccctgggaggagttcgtccatctgcttgcttgccgatcacattggatgttggtacaaataacgaggaactgcttaatgacgaattttacattggcttgagacaaagaagagccactggccaggagtacactgattttctgcaagaatttatgagtgctgtgaaacaaaactatggggagaaagtgcttattcagtttgaggattttgccaaccataatgcttttgatcttcttgcaagatatggcaccactcacctcgtattcaatgatgatattcagggaacagcttctgtggttcttgctgggcttattgcagcacaaacattacttggtggttcattggcagatcacacttaccttttccttggtgctggagaggctgggacaggtatcgctgaacttatagctcttgagatctcacgtcagacgaaagctcctatagaggagtgccgcaagaaaatctggcttgttgattcaaagggcttgattgtcagtacacgaaaggagtcccttcaacacttcaagaaaccatgggctcatgagcataaaccactcagcaacctcttagatgctgttaatgctatcaaaccaacagtgttgattggcacatccgggaaggggcaaactttcacaaaagacgttgttgaagcaatctcctcatttaacgagagaccaatcattcttgccctatcgaacccaacatcacaatctgaatgcacagctgagcaagcttacacatggagcaagggacaagcagtgtttgcgactgggagtccatttgatcctgtggagtacaatggcaagatacatgttcccggacaggcaaacaatgcctatatcttcccagggtttggcctcggcgtggtgatgtctggagctatccgcgttcatgatgacatgcttctggcagcatcggaggctctggcccagcaggtcacagaagaaaattttgagaaggggctgatttatcctcccttctcaaacatcaggaagatctctgcccacattgcagccagcgttgcagcaaaggcatatgaacttggtttggcaagtaggcgccctcggccaaaggacctggtgaaatatgcagagagctgcatgtacagccccatctaccgcaactaccgttgaattcggatcaactccagttatgtgcaaatcagcagcagccttgcgtcaactgcaagatttcctaagaatacaactcggttcagtctttcatactgtaataccctaagctctctagcaaaagctgtttcacgtcctcttctgcccctacatattccgcagtgtttatctcttgcgatgtcatgtaaatcagctccggttaggcttttggatgctagtcagtcatggtgctgctgccgtccttccggacaaggataaatttggaataaagtttgagtcgacgattcctccctcggtactgcgtgttcacctggacgtttttttgcttcacacagttgctgttggtttcaacaaagtgttggttgtatgcgtgaaggtaacaccaggaaagggtcttttttttttccctgaga

SEQ ID NO: 1014 - DNA, 727 bp, Zea mays
gggttcccccaggacttcaggtttatggttacagctcaggggatgtgttcttcaaaagagttgtggccaaggggggagactattttgaagtgcgtgatgccaagcttttttttaatggagtagttcaggatgaggattttgtgtctggagccccccaactacgagatggaaccagtgcttgtcccggaaggttatgtttttgtgttgggggacaaccccaacaacagctttgtttcccccaactggggtccccttccagtggggaacattgtcgggggatttttcctccggttttggcccccctcgaagatcaatgatacaatttttgagcctgatgtgtccccccccccggggccgtcctttttgttgtcgctgcagggatgctggatttccagtgtgtgtccaatgccctttttttttggggggccccctttgatgagttgagcccccgttccaattttttcagaatattgtttcctgggtgttccccgtaaattttttttccctgactgatttgtttttgctcccggttggcagatgctttttcaaagcccgggaaagggcagtcccttcctttttccaatccaaactaattaaaccggttaaaaaaaaaaaaaaaaaaaaaaaaaaaaaaaaaaaaaaaaaaaaaaaaaaaaaaaaaaaaaaaaagggcggccgctctagagtatccctcgaggggccctaagcttacgcgtacccagctttc

SEQ ID NO: 1015 - DNA, 2699 bp, Zea mays
caatcgcgcgggcgcagacagtcggcttccaccaaccacgttgccagcaggcagcggcagcctccacttgctccatgtctccatccaaccctcttccgccgccgggcgagacgcgcgtcggctgctcgttgccctcaccagtcacccctcaggccatgggcgggggccccgctcgtcatgtggccatgcgcgcccttcgcgctcgcttcctctcgcggcagcgggagggaggaccagcggcagcgtcgacctggtggtggtgcgcttcgggttcggcgaagggcgacatggagagcacgctcaaggggatacgcggcagcgatgcgccgtgcgttctggacctggacgacgcggccaccgtggcgggcggcgtcgaggacacctacggcgaggatcgcgccaccgaggagcagctcgtcacgccctggaccgtctccgtcgccagcggttacaatctgcttagggatccccgttacaacaagggacttgcgttcacagagagggaacgtgagacgcactacctccgtggccttctgccaccagctattgtatcccaggagctccaggagagaaagatcatgaataatattcgacaataccagttgcctttgcagcgctacatggcactcatggatctccaggaagggaacgagaggcttttctacaagttgctcattgacaacgtcgaggagttacttccaatcgtgtacactccaaccgttggcgaggcctgccaaaaatatggatccatatttagtcgccctcagggtctttatatcagtttgaaggagaagggaaagatccttgaggtgttgaagaactggccagagaggagcattcaggttatagttgttactgatggtgaacgtattttggggcttggagatctcggatgccaggggatggggattcctgttggtaaactttccctttacactgccctgggaggagttcgtccatctgcttgcttgccgatcacattggatgttggtacaaataacgaggagctgcttaatgacgaattttacattggcttgagacaaagaagagccactggccaggagtacactgattttctgcaagaatttatgactgctgtgaaacaaaactatggggagaaagttcttattcagtttgaggattttgccaaccataatgcttttgatcttcttgcaagatatggcaccactcaccttgtattcaatgatgatattcagggaacagcttctgtggttcttgctgggcttattgcagcacaaacattacttggtggttcattggcagatcacacttaccttttccttggtgctggagaggctgggacaggtatagctgaacttatagctcttgagatctcacgtcagacgaaagctcctatagaggagtgccgcaagaaaatctggcttgttgattcaaaggtcacttttatgaagagggcctcctcgcttttatttcattatatatttgtcttagaacatcagtttattccttattgctaactgtagatactgatcaattaacagggcttgattgtcagtacacgaaaggagtcccttcaacacttcaagaaaccatgggctcatgagcataaaccactcagcaacctcttagatgctgttaatgctatcaaaccaacagtgttgattggcacatccgggaaggggcaagcttacacaaaagacgttgttgaagcaatctcctcatttaacgagagaccaatcattcttgccctatcgaacccaacatcacaatctgaatgcacagctgagcaagcttacacatggagcaaggtaatggtttcaatccgcagtcacgtcaactttttattaaccatggttctgcaactgcactaacgatctgaattcacagggacaagcagtgtttgcgactgggagtccatttgatcctgtggagtacaatggcaagatacatgttcccggacaggcaaacaatgcctatatcttcccagggtttggcctcggcgtggtgatgtctggagctatccgcgttcatgatgacatgcttctggcagcatcggaggctctggcccagcaggtcacagaagaaaattttgagaaggggctgatttatcctcccttctcaaacatcaggaagatctctgcccacattgcagccagcgttgcagcaaaggcatatgaacttggtttggcaagtaggcgccctcggccaaaggacctggtgaaatatgcagagagctgcatgtacagccccatctaccgcaactaccgttgaattcggatcaactccagttatgtgcaaatcagcagcagccttgcgtcaactgcaagatttcctaagaatacaactcggttcagtctttcatactgtaataccctaagctctctagcaaaagctgtttcacgtcctcttctgcccctacatattccgcagcgtttatctcttgcgatgtcatgtaaatcagctccggttaggcttttggatgctagtcagtcatggtgctgctgccgtccttccggacaaggataaatttggaataaagtttgagtcgacgattcctccctcgttactgcgtgttcacctggacgttttttttgcttcacacagttgctgctgttttcaacaagtgcttggttgtatgcgtgaaggtaacaccaggaaaggttcttctttttcttccaaaaaaaaaaaaaaaaaaaaaaatttattgggcggccgct

SEQ ID NO: 1016 - DNA, 1299 bp, Zea mays
atgacgaacgagatggcagcaactaaggcgaggagcatcattattgtgcggagaaacggcggtgagagtcctccagacactgcacagcgcaatggtgacggtgtccgtgagggagcggaggaggtggcaggcctgaacgctggccgcttcccacgtgaagtagtactccagctgccaccaccgcgaggccagccggagaacgatgacgatgacggcgaaaccttttcccctggtcaagattccaggaggcggttctttggggatgtgaggctggaggcggacaggatctttaggatcctgctgcaggacggcccggggttcagcacccgccacgcgctcgatgaaatgcgcccgaaggtgtctattgagctggtgagggaggtgctgttcaggattgttgtgtccgtggacagtgtgaaccgtgagaggtacccgaagctggcgtataagttcttcatatgggcggggcagcaggaggggtaccaacatagcacaagcatgtacaacctcgtcatgaaggttttcgccgagtgtggggaggtgaaggcgatgtggcggctgtttgaggagatggcagccaaggggctacctgtctcttcccggacgttccacctcttgatatgtgcatctgtgaaggttgggttgaggcggagactggtggagaggttcatcaggtcaagtactttcaattaccgcccatttagaaatgcatttaatgcaatattgtacacacttctgaccatagagcagtactcactgattgagtgggttcacgagaaaatgatccttgaggggtactcacctgatgtcttgacatacaatgtggtgttgcgtgcaaagtatatgcttgggaagttggatcaattccatcaattacttgatgagatgggaaaaaatgggcttacgccggacctccatacttacaacctgttgcttcatgtacttggtaagggagacaaacccctcgcagctctcaatttgctgaactatatgagtgatgtcggatgtaggccaaatgtgctccatttcacaaatttgatagatggtcttggccgtgctggcaaccctagaagcctgcaggggctttgcgcagtcggggagtttgataaagcattcactatgctgaaggacatggattcacatggatgcacaccaaacttctctgtgtacagtagtctagtaaggagactgcggaacgctgggaaggatactcaagctaataatgtcattaagtacatgacagataagggtcattatcttcatctgctatcaaggtttggagggtttagaagatgctga

SEQ ID NO: 1017 - DNA, 1826 bp, Zea mays
ggggtggacgaggcgcgccaccggccgagccgaatcgagctgcagaaaccaccttggcatggcgacacaggccgctttcctcgcggggttctcgcagctcgccgcgcagccgggccgtgaccgcgccgtggcggtggcggtggcgccggcgccgggcccggcccgggtggccgttgcggcggtgggtagcgccaagttgggcgtgaaggcggggacgtccaggaccgcggcggtggcgcgcctcggggtgcggtgccgggccagcctgatcgagcccgacggcgggcggctggtggacctggtggcgcccgaggagggcgggcggcgcgcggcgcttcggcgggaggcggcggagctgccgcaccggctgcgcctcggccgcgtcgacaaggaatgggtccacgtcctcagcgaagggtgggcgagtccgctgcaagggttcatgcgcgacgatgagttcctccaaacacttcactttaatgccatccgcggccaggatggcaggatggtcaacatgtccgtccccatcgtgctctccgtaggggacgcacagcgaagggccatccaggccgacggcgccacgcgcgtcgccgtcgtcgacgaacgcgaccgccccatcgccgtcctcagcgacattgagatctataagcataataaggaagaaagaatagcacggacatgggggacaactgcacctggattaccttatgttgaggaggcaattaccaatgctggtgactggttgattggtggggacttggaggttatagaaccaatcaagtacaatgatggtctagatcagtatcgcctgtctccagcacagctgcgtgaagagtttgccaggcgcaatgctgatgcagtatttgcctttcagcttcgcaatccagtacacaatgggcatgctcttcttatgaccgacacacgcaaacgtctccttgagatgggttacaaaaaccctgttcttctgccccatccactgggaggattcacaaaagcagatgatgtgcctcttagttggagaatgaagcaacatgagaaggttcttgaggaaggtgtcctcaacccagaatcaactgttgttgcgatctttccctctccaatgcattatgctgggccaactgaggtgcagtggcatgctaaggctcgtattaatgctggtgcaaatttctatattgttggaagggatcctgctggtatgagccatcccacggagaaaagggacctctatgatgctgaccacgggaagaaggttttgagcatggctcctggcctcgagaggctcaacatccttcctttcaaggtggctgcatatgacacaaagcaaaagaaaatggatttctttgatccatcaaggaaagatgatttcctcttcatctctggcacaaagatgcgcactcttgccaagaaccgagagagtcccccagatggttttatgtgcccgggtggctggaaggtactcgttgaatactatgacagcttggtgccatctgagggcagcagcaagctgcgtgaaccaattgcagcctaaatctggaaaatccttcatataaggaatgctactatatcttagcaagcggttctttgcgacatagaaccgatgctatgtgattgtatactggctgtaagactttaaaacactaggcttgattcggatgttaatgtgtgctttgtacccggtgtaccttctctgctggcagtgttgcacatgcactggagcacatcaaacgtttggtgttaataaggacaggctatgtatcctctgccagatgtacatatatacattgtggtgatatataattataaagctgacctctgccgtccgggct

SEQ ID NO: 1018 - DNA, 664 bp, Zea mays
acttcaaaacagaatcaaatatccactttctctctctctccctccactagagaaaagcttgaaccaaagcaaattcatattttgattctccttcaatggcttccatgtccaccgccttccccaaaacaactcctttcctctctcatcctctcaccaaatccgattccctgatcgcaaccaccgtttcatttccctccagcgcgagatctcgcagcctccgaagagccaccctccgcgtacgatccgcgctgatcgagccagacggcgggaagctggtggagcttgtggtcccggagacgcgacgaagggagaagaagcacgaggcggcggatttgccgagagtgaaactgacggcgatcgatttgcagtggatgcacgtgttgagcgaaggctgggcaagtcccgcttagagggtttatggcgggaagctgagttccttcaaactcttcatttcaattcgcttcgtctcgacgacggatccgtcgtccaatatgtctgtacctatcgttctcgccatcgatgatgaacagaaagctctaatcggagaatctaaacgtgtcgcgcttgttgattcccatggtaaacccaacccctttctcccgggggttttgagaaataacacctccccaagagagaaaaaaattttaaattttgggcccacccc

SEQ ID NO: 1019 - DNA, 1956 bp, Zea mays
ccaagccgtgaggtggacgaggcgcgccacctgctaagccgaatcgagcagcagtagccaccttgccatggcgatgcaggctgctttcctcgcggggttctcgcagctcgccgcgcagccgagccgcgactgcgccgtggcagtggcgccgacgcgggtggccgttgctgcggtgggtagcgccaaggtgggcgcgcgggtaggcttgaaggcggggatcgccgcgcccgcgcccgcgcccgcggcgggccgcggggtgcggtgccgcgcaagcctgatcgagcccgacggcgggcagctggtggacctggtggcgcccgaggagggcgggcggcgcgcggcgcttcggcgggaggcggcggagctgccgcaccggctgcgcctcggccgcgtcggacaaggaatgggtccacgtcctcagcgaagggtgggcgagtccgctgcaagggttcatgcgcgagcatgagttcctccaaacacttcattttaatgccatccgcggccaggatggcaggatggtcaacatgtccgtccccatcgtgctctccgtaggggacgcacagcgaagggccatccaggccgacggcgccacgcgcgtcgcgctcgtcgacgaacgcgaccgccccatcgccgtcctcagcgacattgagatctataagcataataaggaagaaagaatagcacggacatgggggacaactgcacctggattaccttatgttgaggaggcaattaccaatgctggtgactggttgattggtggggacttggaggttatagaaccaatcaagtacaatgatggtctagatcagtatcgcctgtctccagcacagctgcgtgaagagtttgccaggcgcaatgctgatgcagtatttgcctttcagcttcgcaatccagtacacaatgggcatgctctacttatgaccgacacacgcaaacgcctccttgagatgggttataaaaaccctgttcttctgctccatccactgggaggattcacaaaagcagatgatgtgcctcttagttggagaatgaagcaacatgagaaggttcttgaggaaggtgtcctcaacccagaatcaactgttgttgcgatcttcccctctcctatgcattatgctgggccaactgaggttcaatggcatgctaaggctcgtattaatgctggtgcaaatttctatatcgttggaagggatcctgctggtatgagccaccccacagagaaaagggacctctatgatgctgatcacggaaagaaggttttgagcatggctcctggccttgagaggctcaacatccttcctttcaaggtggctgcgtatgacacaaagcaaaagaaaatggatttctttgatccatcaaggaaagatgatttcctcttcatctctggcacaaagatgcgcactcttgccaagaaccgagagagtcccccagatggttttatgtgcccgggtggctggaaggtactcgttgaatactatgacagcttggtgccatctgagggcagcagcaagctgcgtgaaccaattgcagcctaaaatctggaaaatccttcatataaggaatgctactatatcttagcaagcggttctttgcgacatagaaccgatgctatatgattgtatactggctgtaagactttaaaacactaggcttgattcggatgttaatgtgtgctttgtacccggtgtaccttctctgctggcagtgttgcacatgcactggagcacatcaaacgtttggtgttaataaggacaggctatgtatcctctgccagattgtacatatatacattgtggtgatatataattataaagctgtcctctgccgttcgggctcgtagtgatgaacagttttatcactaaaaaaaaaaaaaaaaaaaaaaaaaaaaaaaaaaaaaaaagggcggccgctctagagtatccctcgaggggcccgaagcttacgcgtacccag

SEQ ID NO: 1020 - DNA, 1972 bp, Zea mays
ccgcctttcacaaaaccaaacaaaacgcacccgcaatataaagaggagaccaaggcgtgaagtggaggaggcagaggtggacgaggcgcgccaccggccgagccgaatcgagctgcagaaaccaccttggcatggcgacacaggccgctttcctcgcggggttctcgcagctcgccgcgcagccgggccgcgaccgcgccgtggcggtggcggtggcgccggcgccgggcccggcccgggtggccgttgcggcggcgggtagcgccaagttgggcgtgaaggcggggacgtccaggaccgcggcggtggcgcgcctcggggtgcggtgccgggccagcctgatcgagcccgacggcgggcggctggtggacctggtggcgcccgaggagggcgggcggcgcgcggcgctgcggcgggaggcggcggagctgccgcaccggctgcgcttgggccgcgtcgacaaggaatgggtccacgtcctcagcgaagggtgggcgagcccgctgcaagggttcatgcgcgagcatgagttcctccaagcacttcatttcaatgccatccgcggccaggatggcaggatggtcaacatgtccgtccccatcgtgctctctgtcggggacgcacagcgaagggccatccaggccgacggcgccacgcgcgtcgcgctcgttgacgagcgcgaccgccccatcgccgtcctcagcgacattgagatctataagcataataaggaagaaagggtagcacgaacatgggggacaactgcacctggattaccttatgtcgaggaggcaattaccaatgctggtgactggttggttggtggggacttggaggttatagaaccaatcaagtacaatgatggtctagatcagtatcgcctgtctccagcacagctgcgtgaagagtttgccaggcgcaatgctgatgcagtatttgcctttcagcttcgcaatcctgtacacaatgggcatgctcttcttatgaccgacacacgcaaacgtctccttgagatgggttataaaaaccctgttcttctgctccatccactgggaggattcacaaaagcagatgatgtgcctcttagttggagaatgaagcaacatgagaaggttcttgaggaaggtgtcctcaacccagaatcaactgttgttgcgatctttccctctccaatgcattatgctgggccaactgaggtgcagtggcatgctaaggctcgtattaatgctggtgcaaatttctatattgttggaagggatcctgctggtatgagccatcccacggagaaaagggacctctatgatgctgaccacgggaagaaggttttgagcatggctcctggcctcgagaggctcaacatccttcctttcaaggtggctgcatatgacacaaagcaaaagaaaatggatttcttcgatccatcaaggaaagatgatttcctcttcatctctggcacaaagatgcgcactcttgccaagaaccgcgagagtcccccggatggttttatgtgcccgggtggctggaaagtgctcgttgaatactatgacagcttggtgccatccgagggcagcagcaagctgcgcgagccagttgcagcctgaaatatgggaagcgcttcagataaggaaccgtactatgtcagcacaagcggttctttgcgacatagaaccgttgttgtatgattgtatactggcttgtaagacttaaaaacactgggcttgatttggacgttaatgtgtgcattgtaactggtgtgccctatctgctgacagtgttgcacatcacatgtttggtgttaataaggacagactatgtatcatctgccagattgttgtacatatacattgtggtgatataaacatgaagctgtcttctgctattttataaccaaaaaaaaaaaaaaaaaaaaaaaaagggcggccgctctagagtatccctcgaggggcccgaagcttacgcgtacccagctttc

SEQ ID NO: 1021 - DNA, 809 bp, Zea mays
gacgaggcgcgccaccggccgagccgaatcgagctgcagaaaccaccttggcatggcgacacaggccgctttcctcgcggggttctcgcagctcgccgcgcagccgggccgcgaccgcgccgtggcggtggcggtggcgccggcgccgggcccggcccgggtggccgttgcggcggtgggtagcgccaagttgggcgtgaaggcggggacgtccaggaccgcggcggtggcgcgcctcggggtgcggtgccgggccagcctgatcgagcccgacggcgggcggctggtggacctggtggcgcccgaggagggcgggcggcgcgcggcgctgcggcgggaggcggcggagctgccgcaccggctgcgcttgggccgcgtcgacaaggaatgggtccacgtcctcagcgaagggtgggcgagcccgctgcaagggttcatgcgcgagcatgagttcctccaagcacttcatttcaatgccatccgcggccaggatggcaggatggtcaacatgtccgtccccatcgtgctctccgtcggggacgcacagcgaagggccatccaggccgacggcgccacgcgcgtcgcgctcgttgacgagcgcgaccgccccatcgccgtcctcagcgacattgagatctataagcataataaggaagaaagggtagcacgaacatgggggacaactgcacctggattaccttatgtcgaggaggcaattaccaatgctggtgactggttggttggtggggacttggaggttatagaaccaatcaagtacaatgatggtctagatcaagtatcgcctgtct

SEQ ID NO: 1022 - DNA, 1623 bp, Zea mays
aaagaggacaccaaggcgtgaagtggaggaggcagaggtggcgcgcctcggggtgcggtgccgggccagcctgatcgagcccgacggcgggcggctggtggacctggtggcgcccgaggagggcgggcggcgcgcggcgctgcggcgggaggcggcggagctgccgcaccggctgcgcttgggccgcgtcgacaaggaatgggtccacgtcctcagcgaagggtgggcgagcccgctgcaagggttcatgcgcgagcatgagttcctgccaagcacttcatttcaatgccatccgcggccaggatggcaggatggtcaacatgtccgtccccatcgtgctctccgtcggggacgcacagcgaagggccatccaggccgacggcgccacgcgcgtcgcgctcgttgacgagcgcgaccgccccatcgccgtcctcagcgacattgagatctataagcataataaggaagaaagggtagcaagaacatgggggacaactgcacctggattaccttatgtcgaggaggcaattaccaatgctggtgactggttggttggtggggacttggaggttatagaaccaatcaagtacaacgatggtctagatcagtatcgcctgtctccagcacagcctgcgtgaagagtttgccaggcggaatgctgatgcagtatttgcctttcagcttcgcaatcctgtacacaatgggcatgctcttcttatgaccgacacacgcaaacgtctccttgatatgggttataaaaaccctgttcttctgctccatccactgggaggattcacaaaagcagatgatgtgcctcttagttggagaatgaagcaacatgagaaggttcttgaggaaggcgtcctcaacccagaatcaactgttgttgcgatctttccctctccaatgcattatgctgggccaactgaggtgcagtggcatgctaaggctcgtattaatgctggtgcaaatttctatattgttggaagggatcctgctggtatgagccatcccacggagaaaagggacctctatgatgctgaccacgggaagaaggttttgagcatggctcctggcctcgagaggctcaacatccttcctttcaaggtggctgcatatgacacaaagcaaaagaaaatggatttcttcgatccatcaaggaaagatgatttcctcttcatctctggcacaaagatgcgcactcttgccaagaaccgtgagagtcccccggatggttttatgtgcccgggtggctggaaagtgctcgttgaatactatgacagcttggtgccatccgagggcagcagcaagctgcgcgagccagttgcagcctgaaatatgggaagcgcttcagataacgaaccctactatatcagcacaagcggttctttgcgacatagaaccgttgttgtatgattgtatactggcttgtaagacttaaaatcactgggcttgatttggacgttaatgtgtgcattgtaactggtgtgccctatctgctggcagtgttgcacatcacatgtttggtgttaataaggacaggctatgtatcctctgccagattgttgtacatatacattgtggtgatataaacatgaagctgtcttctgctgttttataaaa

SEQ ID NO: 1023 - DNA, 1231 bp, Zea mays
ttaaagccaagggagctccagctcccgagtttccccaaacacttcatccaggctccagccatggaggcctcggcagcggtcgagtcgtcggccgccgtgtctgtcttcgaggtagtgtccagcaagcagcggcggccgccggacacggcgaagctggtgctgaatagccccagcccgccgagcctgcgggaggagctcgtcggcgtggtcggcaaggcgttccggccgcgcgcccacgccggggcggctgctggcgccggtggccgcccgccgccgcgccgcgcgtgggtcctcacggcgctgcagtgcgtgttcccggtgctgcagtgggggaggagctacaccctcgagtccttcaggagtgacgtcatggccggcctcactcttgccagccttggcatccctcagcaagaaataacaaccaacaagctagaatttaattcaacacgtcttcaggtgaaaactgacaaggagatcgccatcgggccagtcgccgtcgtctcgctgctgctgtcctcgatgatccagaaggtcgtcgacccggccgccgacccggcgacctacaggtcgctcgtcttcacggtgactttcctcgccggggtcttccaggtctccttcggcctcttcaggctggggtttctcgtggatttcctgtcgcacgctgccatcgtggggttcatgggcggggcggccatcgtgatcgggatgcagcagctcaaggggctgcttggcctcgcccatttcaccaacagcaccgatgttgtttctgtcctcaaggctgtctgctctgcgctacgacatgacccgtggcacccgggcaacttcctcatcggatgctccttcctcatattcatcctcactacacggttcatcgggaggaggtacaagaagctgttctggctgtcagcgatctcgcctctgctgtcggtcatcctgtccaccgctgcggtctacgcgacaagggctgacaggcacggcgtcaagatcatccagaaggtgcacgcgggcctaaacccaagctccgtgaagcagatacacctcaacgggccgcacacaacggagtgcgccaagatcgccgtcatctgcgcagtcatcgccctcacggaagctatcgccgttggccgatctttcgcctccgtaagagggtacagactcgacggcaacaaggagatgctggccatggggttctccaacgttgctggttctctgtcctcgtgctatgtggcaacag

SEQ ID NO: 1024 - DNA, 1416 bp, Zea mays
atgagctcggcgagggtgagaggccccttcacgccgccgcagtggatcgagctggagcaccaggccctgatctacaagtacctgtccgcgaacagccccgtacctcacagcctcctcgtccccatcaggaggagcgggagcctcgcatcgtctccctacccgcctccctacttcggcacgagcacattcgggtggggctccttccagctgggctactccggcaatgcggatctggagcctgggcggtgccgccggacggacggcaagaagtggcggtgctccagggacgcggtcgccgaccagaagtactgcgagcgacacatgaaccggggacgccatcgttcaagaaagcatgtggaagaccagcctggccatgccgcgaaagccatgtccgcggtggccgtggcggctgctgctgctgctgctacccagcatgctgctgctctggccggcgccggagctactgctgctgctggcctcgctgtcaatcggcaccggcagccggggaagagctatgccacgggtgcgactgatccatgctctctgcaatatagcagggaactggcgaacaaactgtcgaacgagagcgaaaacatgcaggactctgacaatgtctcgatgctgacttccatgaacacaggaaacactgcaggcagcgtgtttccgttctcgaaacagaacactgctcttttcgaagtgagcagctcaaggccagagtttggtcttgttccatcggattcactgacgagttcacctcatagttccttgaagagtgtcaaaaatctgctcagctcacggagtctgagtgagcaccagagctccgcctccctgcaacactttgtggactggcccaggacgccacctgcccagggaggtctttcatggcccgaggcagaggacatgcccagagctcagaggtcccagctctcagtatccgctccaatggcatcctccgagctatcatcggcctccacatctcccatccacgaccacgagaagctgattctgtcacctctcaagctgggccgcgagtataccccatctggcgtcgtcagcgctgcagcgaacagatacgaggttagccagctagaagcgacctgggcgacgatgttccgcgactcttcgacgggcggcccgttgggggaggttctggccaagaacaacagcaacgcggaagcaagaggttgcccgtcggcggcgccacctctaaccgactactactgctgggattcaggccacggcatgcagtcgtcccccgtgggagttctgcagaggacgaccgccttcggatcggtctccagcagcacgggcagcagccctagggtcgagaaccacggcgcctgctgcgatggtaccagcaacctgatggatgatctcggttcagttgtagtgagacatcccagcatccgcctcttg

SEQ ID NO: 1025 - DNA, 1107 bp, Zea mays
atggaaggaggccgagatgtgttcttaggtgcggcggcaagggcgccgccgccgccgccgtcttgcccgtttcacggatccgctaccgccacccgctccggtggagcgcagatgctcagcttctcctccaatggcgtagcagggttgggtctgtgctcaggtgccagcaagatgcagggtgtgttgtcgagggtgaggaggcccttcactccgacgcagtggatggagctggagcaccaggccctgatctacaagcacttcgctgtgaatgcccctgtgccgtccagcttgctcctccctatcaaaagaagcctcaatccatggagcagccttggctccagctcattgggatgggcaccatttcgttccggctctgctgatgcagaaccaggaagatgccgccgcacagatggcaagaagtggcggtgctctagagatgctgtcggggaccaaaaatactgtgagcgacacataaaacgtggttgccaccgttcaagaaagcatgtggaaggccgaaaggcaacaccgaccactgcagatccaaccatggctgtttctggtggttcattgttgcacagccatgctgttgcttggcagcagcagggcaaaagctcagctgctaatgtgactgatccattctcactagggtccaacaggaatttgctggataagcagaatctaggtgaccagttctctgtatccacttccatggactcctttgacttctcatcatcacattcttccccaaaccaagccaaagttgcattttcaccggtggccatgcagcacgaacatgatcagctgtatcttgtgcatggagccggcagctcagcagaaaacgttaacaagtctcaggatggtcagctgctagtctcgagggaaacaattgacgacggacctctgggcgaggtgttcaagggcaagagttgccagtcagcatccgcagacatcttaactgaccattggacttcgactcgtgacttgcgtcctccaaccggagtcctacaaatgtctagcagcaacacagtgccagcagagaatcacacgagtaacagtagctatctcatggcgaggatggcgaattctcagaccgtcccaacactccac

SEQ ID NO: 1026 - DNA, 1440 bp, Zea mays
atgccgctgtactacgggaccccggcctcttgctcaggattgagctcggtgagcttgagcaccagcatgcagggggcaatggccagggtgagggccccattcacgccgtcccagtggatcgagctggaacaccaggccctgatctacaagtacctggccgcgaacagccccatacctcacagcctcctcatccccatcaggaggagcctcgctgcgtctccctacccgccttcatacttcggcacgagcacattggggtggggctctttccagctgggctactccggcaatgcggatctggagcctgggcggtgccgccggacggacggcaagaaatggcggtgctccagggacgcggtcgccgaccagaagtactgcgagcgacacatgaaccggggacgccatcgttcaagaaagcatgtggaaggccagcctggccatgccgcgaaagccatgtccgcggtggcggcggcggctgctgctgctacccagcctgctgctatggccggcgccggagctcctgccgctggcctcactgtcaatcagcaccagctgacggcgaagagctacgccacgggtgcgactgacccttgctctctgcaatataacagggaactggtgaacaaacagaatgagagcgaaaacatgcaggactccgacaacctctcgatgctgacttccatgaacacaggaaacacaggcagcgtgttcccattctcgaaacaaaacaccaatccttttgaagtgaccagctcaaggctagagttcggcctcgtttcatcggattcactgatgagttcccctcacagttccttggagaacgtcaacctgctcggctcacagagtatgaatgaacaccagaacccagcctccctgcaacacttcgtggactggcccaggacgcctgcccagggaggcctttcatggcccgaggcagaagacatgcaggctcagaggtcacagctctccatatctgctccgatggcatcctccgagctatcgtcggcctccacatcccccatccacgagaagctgatgctgtcgcctctgaagctgagccgcgagtacagtccgactggtctcggcattgcggcgaacagagacgaggttagccagctagaagcaacctgggcgacgatgttccgtgactcttcgatgggcggtccgttgggggaggttctggccaagaacggcaacgtggaagcgagaaattacctgtcggcgcctctgaaccttctcaccgactactgggattcaagccacgggatggagtcctcccctgtgggcgttctgcagaagacgaccgccttcggatcggtctccagcagtacagggagcagccctagggctgagaaccacggcgcctacgacggtttcggcaacctgcgggatgatctcggctcaattgtagtgcgccatccaagcatccgccttgtgtga

SEQ ID NO: 1027 - DNA, 1188 bp, Zea mays
atgatgctgagcgggcacggcggcgagaggcgcctgttcacggcgtcgcagtggcaggagctcgagcaccaggcgctcatcttcaagtacatggcctcgggcgcgcccgtgccgcacgacctcgtcctaccgctccgcctcgccaccggcgtcgacaccgcgccctccctcgccttcccgccgaagccttcgccgtcgcgtacgacctgcgcgcttctctcctcccgacccgacctcccccgtcctcgcctcatgtttcactctgatcatcgacagccatcagcccatcacatcatcgctgatgactttgtacgtgtgaccgtgcatgcagtggcgtactggggctgctacggcgcgggggcgccgttcggccgcaaggcggcggaggacacggagccggggcggtgccggcggacggacggcaagaagtggcggtgctccagggaggcccacggcgactccaagtactgcgagaagcacattcaccgcgggaagagccgttcaagaaagcctgtggaagtgacctcctcccccgccgccggccccgctgcggcgtaccgaccgtccgcgatctccaccatctcgccgccccgcgcggccgacgcgccgccgccgagcctcgcctacccgcagcagcatctcctccacggcgcctcctccgcagcaggagcagcagcccgcgtccccgctggcgctctccagctccacctcgacgcgagcctgcacgcggcggcggcggcggcgtcgccatcgccgccgccgtcctaccacaggtacgcccactacacaccgccagcgtcgtcgctcttcccgggcggcggctacggctacgactacgactacgggcagtccaaggagctcaggcgacggcacttccacgcgctcggggccgacctgagcctcgacaagccgctgcccgagcccgacaccggctccgacgagaagcagcccctgcggcgtttcttcgacgagtggccgcgggagagcggcgacatggccgcggacgacgcgacgcagctttccatctccatccccgcggcttcgccctccgacctcgctgctacctccgcctccgccgccgccgcgcgattccacaacggtgaggcggcgagccaaagactccactttcattggttccttgcgtacgataggatcgctgattggtgctgccgcttcatcattgtttaa

SEQ ID NO: 1028 - DNA, 993 bp, Zea mays
atgatgctgagcgggcacggcggcgggaggcgcctgttcacggcgtcgcagtggcaggagctggagcaccaggcgctcatcttcaaatacatggcctccggcgcgcccgtgccgcacgacctcgtcctgccgctccgcctcgccaccggcgtcgacaccgcgccctccctcgccttcccgccccagccttcgccgtcgctggcgtactggggctgctatggcgcgggggcgccgttcggccgcaaggcggaggacccggagcccgggcggtgccggcggacggacggcaagaagtggcgatgctccagggaggcccacggagactccaagtactgcgagaagcacatccaccgcgggaagagccgttcaagaaagcctgtggaagtgacctcccccgccgcctaccgcccgtccgcgttctccatctcgccgcctcgcgcggccgacgcgccgccgccgccgccgggcctcggccacccgcagcagcagcatctccgccacggcgctctctctccagcaggccgcgcccacgccgctggcgctctccagctccacctcgactcgagcctgcacgcggcgtcgccgccgccgtcctaccacaggtacgcccactcccacgctcactacacgccgccgccgccgccgtcgctctacgactacgggcagtccaaggagcttcgggaggcggcggagctcaggcggcggcacttccacgcgctcggggccgacctgagcctcgacaagccgctggccgacgccggggccgcggagaagcccctgcggcgtttcttcgacgagtggccgcgggagagaggcgacacgaggccgtcgtgggcgggggcggaggacgcgacgcagctctccatctccatccccgcggcttcgccctcctctgaccacgctgcctctgccgccgcgcgatgccacaacgtctgcggtgcgagccttgtcagctcttttccggtgacccacgcctttgattcctttctctga

SEQ ID NO: 1029 - DNA, 1535 bp, Zea mays
gaaaaaaaaaaaaaaaaaaaaaaaaaaaaaaaaacagcacagcagccgccctgctcggcgtaggagcagcccagagcgagcgagacagagggaaagagacacggccagccaggtaaggcaaaagagagagggcggaagcagcggcagagcggagagggagagagaagagcatatatgggcatggcgatgccctttgcctccccgtctccggcagccgaccaccgcccctcctccctcctccccttctgccgcgccgcccctctctccgcggcgggagaggacgccgcgcagcagcacgcgatgagcggcaggtgggccgcgaggccggcgctcttcacggcggcgcagtacgaggagctggagcaccaggcgctcatatacaagtacctcgtcgccggcgtgcccgtcccgccggacctcctcctccccctgcgccgaggcttcgtcttccaccagccacccgcccttgggtacggcccctacttcggcaagaaggtggacccggagcccgggcggtgccggcgtacggacggcaagaagtggcggtgctccaaggaggccgccccggactccaagtactgcgagcgccacatgcaccgcggccgcaaccgttcaagaaagcctgtggaagcgcagctcgcgcccccgccgcacgcccagccgcagcagcagcagcaggcccccgcgcccgctgctggcttccagaaccactcgctgtacccgtcgatcctcaccggcaacggcggcggcggggtaggtgctggtgctggtggtggcacgttcggcctggggcccacctctcagctgcacatggacagtgccgctgcctacgcgactgctgccggtggagggagcaaatatctcaggtactctgcatacggggtgaaatctctgtcggacgagcacagcacgctcttgtcgggcggcatggatccgtcgatgatggacaactcgtggcgcctgctgccatcccaaaccaacacattccaagccacaagctaccctgtgttcggcacgctgagtgggctagacgagagcaccatcgcgtcgctgccgaagacccagagggagcccctctctttcttcgggagcgacttcgtgaccgccgccaagcaggagaaccagacgctgcgccctttcttcgacgagtggcccaagtcgagggactcgtggccggagctgggcgaggacagcagcctcggcttctcggccacccagctctccatctccattcccatggcgacctccgacttctccaacaccagctccagatcgccgggtggaataccgtcgagatgaacgagtaccgtgcatgtggatcccagcgtcttagggttgacgactcttcggtgctggcctcatcgtatcatgctcctaaattttcgaacgatatatgccttatgtaacgctatttctctcattgttacaacaccctttacccgtttggaattgtgttgaagtggatggtctgcgttgctcggttgttcatttgacttttttttcaatttggaagctccgtttcttggtactcagtt

SEQ ID NO: 1030 - DNA, 1544 bp, Zea mays
  misc_feature (309)..(309): n is a, c, g, or t
atggcgatgccgtatgcctctctttccccggcaggcgccgccgaccaccgctcctccacagccacggcgtccctcgtccccttctgccgctccactccgctctccgcgggcggcgggctgggcgaggaggacgcccaggcgagcgcgaggtggccggccgcgaggccggtggtgccgttcacgccggcgcagtaccaggagctggagcagcaggcgctcatatacaagtacctggtggcgggcgtgcccgttccgccggatctcgtggttccaatccgccgcggcctcgactccctcgcaacccgcttntacggccaacccacactcgggtacggaccgtacctggggaggaaactggatccggagcccggccggtgccggcgaacggacggcaagaagtggcggtgctccaaggaggccgccccggactccaagtactgcgagcgccacatgcaccgcggccgcaaccgttcaagaaagcctgtggaaacgcagctcgcgccccagtcccaaccgcccgccgccgcagccgtctccgccgctccgcccctggcagccgccgccgccgccaccaccaacggcagcggcttccagaaccactctctctacccggccatcgccggcagcactggtggtggaggaggagttggcgggtccggcaatatctcctccccgttctcctcgtcgatggggggatcgtctcagctgcacatggacagtgctgccagctactcctacgcagctcttggtggtggaactgcaaaggatctcaggtacaacgcttacggaataagatctctggcggacgagcacaaccagctgatcgcagaagccatcgactcgtcgatagagagccagtggcgcctccccagctcgtcgttcccgctctcgagctacccacatctcggggcgctgggcgacctgggcggccagaacagcacggtgagctcgctgccgaagatggagaagcagcagccgccctcgtccttcctagggaacgacaccggggccggcatggccatgggctccgcctccgcgaagcaggagggccagacgctgcggcacttcttcgacgagtggcccaaggcgcgggactcctggccgggcctctccgacgagaccgccagcctcgcctcgttccccccggcgacccagctgtcgatgtccatacccatggcgtcctccgacttctccgtggccagctcccagtcgcccaacgatgactaatggtgcgtggatcgtcgcgttctggccctttgtctgtcttccctccagtcctccacccaccgcgcagtagtacctgcggaaacagcccatgctcctgtatatttgtcggtcattttccgtgtcagatctgtgtaccaaaccaagcggcggcggccgtcgtctctccccgcctccgcctcgcctcatgtgggtgggtgaacatgagaccgttttgcttaggctcaaagctttgtgtgaccccaaaaaaaaaaaaaaaaaaaaaaaaaagggcggccgctctagagtatccctcgaggggcccagagcttacgcgtacc

SEQ ID NO: 1031 - DNA, 1683 bp, Zea mays
cttcactcactcctgtcctctcctctcgaccagctgacctcgctgacggagcacacagccacgccgcagcgccgcgtgggtgtctgtctatagccttgtaggtcgttcgcaggtaggtaaccgtaacctagctagctcgtcgggatgatgatgatgagcggtcgagcggccaccgcggggcggtacccgttcacggcgtcgcagtggcaggagctggagcaccaggcgctcatctacaagtgcctggcgtccggcaagcccatcccgtcctacctcatgccaccgctccgccgcatcctcgactccgccctcgccacgtcgccgtcgctcgccgccttcccgccgcaaccctcgctggggtgggggggctgcttcgggatgggcttcagcaggaagcccgccgacgaggacccggagcccgggcggtgccggcgcacggacggcaagaagtggcgctgctccaaggaggcgtacccggactccaagtactgcgagaagcacatgcaccggggcaagaaccgttcaagaaagcctgtggaaatgtccttggccacgccggcgccggcctcctccgccacaagcgccgccgccgccgccacctcctcgtcccaggcgccgtcctaccacagcccggcccccgccgtgccgtaccacgcgccctacggcgccgcgtaccatcacacgcagacgcaggtgacgatgagccccttccacctcctccacctcgagaccacccacccgcacccgccgccgccgccgccgccgccctactactacgcggaccagagggactacgcctacggcaaggaggtcggcgagcgcgccttcttctccgacggcgcgggcgagagggaccggcagcagcaggccgcggggcagtggcagttcaagcagctcgggacgatggaggcgacgaagcagccgtgcaccacgccgctgctcgtccccgccgccgggtacggccacggcgcggcgtcgccgtacggcgtcggtcaggccaaggaagacgaggaggaggaggaaacgcggcggcagcagcagcactgcttcgttcttggcgccgacctgcggctggcggagcggccgtcgggggcacatgacgccgccgcgcagaagccgctccggcatttcatcgacgagtggccgcacgagaaggggagcaataaggcggggtcgtggatgggggggctcgacggcgagacgacgcagctctccatgtctatcccgatggcggccgctgccgacctccccgtcacctcccgctaccgtacgtgatggcggcgcgcactatgagtgattgccagcaagaaatgttttgtggttgctgcgacctcgaggtggcgaggccacatgaaaaaaaaatactggagctggaacacgagtggttctttcctgtgccgttttgctcagggccggtcggcacggtttgaagaagttgggaagagaagtaaaataaacctccttgggagtgttacgtttcctgtaattgcttgcttcctttgctgtacctgtgagacgacgcttagtgctagaagtgagggcctttcctgatctcagctctggtctggatttgccttttcccgctgtcggattcctctgcctgtctgtgatggtttgtctgtgatggtttgtgctcagagcctgcagcgaatactaaaccgcagtaattaatcaaaaaaaaaa

SEQ ID NO: 1032 - DNA, 1233 bp, Zea mays
atgggtgggtctgaagccgccacatgtccagagaaggcggcacactccaaagcatcaacagtgagtccagacccccacgggagagcgccggacccccggatgtacagtccaaacccccaaggatggtcccggacccccgaatatacagtccggacccccaagggtaaaaaggagcctatttatatagttgggtacgggacgtacttcggcaagaggctggatccggagccggggccggcgcacggacggaaagaagtggcggtgctccagcgaggccgccccggactccactgcgagcgccacatgcaccgcggccgcaagcgttcaagaaagcctgtggaaacgcagcccgcgccccagtcccaaccgcccgccgccggcgccgccgccgccgccaacggcagcagctttcggaaccactccctctacccggccattgccggtggtggaggtggcggggccagcagtatctctgctcccccgttctcgtccatagagagtcgtctcagctgcacatggacagtgctgctgccagccgcagctcttgggggtggaggccgccaagatggcccgccgccatgcgcgttgctgggattccgcgcccgcctccagcacaggtcggatgcctccacggacggaatggtggccatcaccggcgaatccatggagttgcccggacgcgcctgcgatgtggcctcgcccagcagcgccgttacctcgactcgccgcgccgacggatcctacaggcgcgctgtggcctcgcccgtctacgtcgttgcgtcgactcgccgcgccgatggaagagcccagggatccttcaggcgcgccatggccgagtgcgggtgcgggcgcgctttggcctcgcccggctgcgccgtggccgccagttgctgcgccggctcctacggccgcgatttggccttgcccgtctgcgccgttgcgtcgactcgccgcgcccatggatgcgcccaggtatccttcaggcgcgccatggccgagtgcgggtgcgggcccgctttggcctcgcccggctgcgccgtggccgccagttgctgcgtcggctcctaccgccgcgatttggccttgcccgtctgcgccgttgcgtcgactctccgcgcccaggtatccttcaggcgcgccatggccgagtgcgggtgcgggcccgctttggcctcgcccggctgcgccgtggccgccagttgctgcgccggcgatcccttgccggggtcgtaa

SEQ ID NO: 1033 - DNA, 1127 bp, Zea mays
tgctcctccttcgcctccgtgctccgccggccgcagacacaagtttaccgagcgaccagacggcgggagccgtcacgcataaatatacccaccacttcacacttcctctgtcgagaacgaatgctgtctcttcttcccttctatcgagaagctgcccgcgcgctccctccgtagagtccaaaccgccacaggaagcgcaacagcggagtctccaaaatggccgccgaggacaaggagaccgactcgccgcagccgccggcgaagctgccccgtctctcctgcgccgacacgagcgccggagtggcggcctcgtcgcctctggttctcgggctgggcctggggctcggcggggggcggcgagcgagacgcggatgcgtccccggcaacggcgacgcccaagaggccgtcagcgctgacgttcatgcagcagcaggaactggagcaccaggtgctcatctaccgctacttcgcagcgggcgcgccggtgccggcgcacccttgtgctccctatctggaagagcgtcgccgcgtcctccttcggcccgcagcgcttcccctcgctgatgggcctggggagcctgtgcttcgactaccgcagcagcatggagccggagcccgggcggtgccggcgcacggacggcaagaagtggcggtgctcccgcgacgtggtgccgggccacaagtactgcgagcggcacgtccaccgcggccgcggccgttcaagaaagcctgtggaagccgccgccccggcgcccagcgcggcggccgccaccagcctcggcaggcggccccgtccaccacacgggcggcgcgcccccgccgcacgggctcggcctctcccccaccagcgtcctcctcgcccacagcgccgcgcgtgccacatgagtagagcgctgcgggccgacatcttgggctgggcctcggaatcacgaggagaaacggaatccgcagggattacaatgtcgtgtgcgtgctgtgatttttttcactcccaaaagtcgcagcttcttaaaaaacccggtttgggacgtccgatggcatgtgtcgctggcagctggttcgctgcgtttgcttctctgttacgtgtgcattgtattgttttgcctgcctcaaaaaaaaaaaaaaaa

SEQ ID NO: 1034 - DNA, 1749 bp, Zea mays
gggcctatttagggtgaactatagaacaagtttgtacaaaaaagcaggctggtaccggtccggaattcccgggctcgcgctcttgccaccgtctactctccaacctttctgtcatatacctcggcaccagctcgctgacgctaccgccacccctaccgccaggccgcatagccgtgctccgctcaccttctctcgcgctacagtctcaagggtagctagccaagctaccaagctcgtcaggagcgagagaaagaggccgccggcggtgcgcggggatgatgatgatgagcagcggccgggcgggcggcggggccaccgcggggcggtacccgttcacggcgtcgcagtggcaggagctggagcaccaggcgctcatctacaagtgcctggcgtccggcaagcccatcccttcctacctcatgccgccgctccgccgcatcctcgactccgccctcgccacgtcgccgtccctcgcctacccgccgcaaccctcactgggctggggctgcttcgggatgggcttcacccggaaggccgacgaggacccggagcccgggcggtgccggcgcacggacggcaagaagtggcgctgctccaaggaggcgtacccggactccaagtactgcgagaagcacatgcaccggggcaagaaccgttcaagaaagcctgtggaaatgtccttggccacgccggccccggcgccggcccccgccgccgccacaaccgccaccgccacctcatccccggcgccgtcctaccaccgcccggcccacgacgccacgccgtctccgtaccacgcgctgtatggaggcggcggcggcggcggcggtagcccttactcggcgtcggcacgcccaggagcaaccggaggcggcggcgcgtaccaccacgcgcagcatgtgagccccttccacctccacctcgagaccacccacccgcacccgccgccgccctacaactactccgccgaccagagggactacgcgtacgggcacgcggccgccaaggaggtcggcgagcacgccttcttctcggacggcgcgggcgagcgggtcgaccgccaggccgcggcggggcagtggcagttcaggcagctcggggtggagacgaagccgggccccacgccgctgttccccgtcgccgggtacgggcacggcgcggcgtcgccgtacggcgtggagatgggcaagtacgacgacgagcaggaggagaggcgccgccagcactgcttcgttcttggagccggcctgcggctggagcggccgtcgtcgggccatggccatggccatgaccatgacgacgccgccgccgcgcagaagccgctccggcccttcttcgacgagtggccgcaccagaagggggacaaggccggttcgtggatggggctcgacggcgagacgcagctctccatttccatccccatggccgctaccgacctccccgtcacctcccgcttccgtaacgacgagtgatgccacatcaaacctggcgctggaaactcggaacgcatggtgctgatgctgaccatgagatgtaccgtttcgctcaaggccggccgtcatcaccacggccacatcaaaccggtttgaagaacttgggaaggccgaatgaaacctccagaagaatgatctgtcctcttttttctgcatttctttttctcttagtattacgcagtattgcttcgcgtgtaatatgttttcctgtaatatcaagtgagggcgtttctgaaaaacaaaaaaaaaaaaaaaa

SEQ ID NO: 1035 - DNA, 801 bp, Zea mays
actcttgcctctatcccagcgtgttcattccaacacaagaacaacacacacgacgcgcactcgcaccagccagccacggaggaagaaaggcgcactccagagatgaccgagcgaaggcaggaacactcgccgccgtccaagctcccccgcctctccggccccgacgccgacgacaacgacggcgcagggacggtgaccatggcggcgccgtcgccgctggttcttgggctgggtctcggcgtaggcggcagcagcagtgacagtggacgtggcgacgcggaggcatctgcggcgacgcggccatcggcgctgacgttcatgcagcggcaggagctggagcaccagtggcgggactggggagcatgtgctacgaccacaggagcagcatggagccggagccggaccggtgccggcgcacggacggcaaaaagtggcggtgctcgcgcggcgtgatgccggggcacaagtactgcgagcgccacgtccaccgcggccgcggccgtgcaagaaagcctgtggaagccgcgccggccacatcagccatcccgatccgcgcaatgcacgccgccgacgcgcagggcgccacaagcgcgcacgcggcgccaccgcagcgcctcggcttctcctcccccgccggcgtctacctggcccacggcaccgcccgtggcacctgacctgatgacggcattttcttcagttagctacagatgttttgcttccttgtttgtgctaatctgtagcggggaaatctccgaggattatgctgtactggtgctggtaattttattttcgccttgactg

SEQ ID NO: 1036 - DNA, 1429 bp, Zea mays
gcccccgtccgtccgtccgtccctcacctcggcccgcctccctcatcaggtagccgtagcgagcagtatagcacgcacagccgccgccctgccctgccctgctcggcgtaggcacaggcacagcccagagcgagcgagacagagggaaagagacagagccagccaggtaaaaggcaaaagcacagcacattaaaagagaggccggaagcagcggcagagcggagagagagagagagaactagaagcatatatggcgatgccctttgcctccctgtctccggcagccgaccaccgcccctcctccctcctcccctactgccgcgccgcccctctctccgcggtgggagaggacgccgccgcgcaggcgcagcagcagcagcagcagcacgctatgagcggcaggtgggcagcgaggccgccggcgctcttcaccgcggcgcagtacgaggagctggagcaccaggcgctcatatacaagtacctcgtcgccggcgtgcccgtcccgccggacctcctcctccccctacgccgaggcttcgtctaccaccaacccgcccttgggtacgggccctacttcggcaagaaggtggacccggagcccgggcggtgccggcgtacggacggcaagaagtggcggtgctccaaggaggccgccccggactccaagtactgcgagcgccacatgcaccgcggccgcaaccgttcaagaaagcctgtggaagcgcagctcgtgcccccgccgcacgcccagcagcagcagcagcagcaggcccccgcgcccaccgctggcttccagagccaccccatgtacccatccatcctcgccggcaacggcggcggcggcggcggggtaggtggtggtgctggtggcggtggcacgttcggcctggggcccacctctcagctgcacatggacagtgccgctgcttacgcgactgctgctggtggagggagcaaagatctcaggtactctgcctacggggtgaagtctctgtcggacgagcacagccagctcttgtccggcggcggcggcatggacgcgtcaatggacaactcgtggcgcctgttgccgtcccaaaccgccgccacgttccaggccacaagctaccctctgttcggcgcgctgagcggtctggacgagagcaccatcgcctcgctgcccaagacgcagagggagcccctctccttcttcgggagcgacttcgtgaccccgaagcaggagaaccagacgctgcgccccttcttcgacgagtggcccaagtcgagggactcgtggccggagctgaacgaggacaacagcctcggctcctcggccacccagctctccatctccatccccatggcgccctccgacttcaacaccagctccagatcgccgaatggaataccgtcaaggtttgagcctttcgttctgcgaaccttcttctaa

SEQ ID NO: 1037 - DNA, 2239 bp, Zea mays
atgaccatggcatcccctcctctgcaaaagcccgtgcctttggtgtcttgtcacgggcaaaagtggcgcatgttcattattatcccccctgcctttttgctttcgcaagccctgaggccattggtcacgggtactgttccccctactgttcttgcttcccgtgtcctgaccatttcagtattcgttcttgttactgatggtgttcttgtgatgaagggttgggtctgtgctcaggtgccagcaagatgcagggtgtgttgtcgagggtgaggaggcccttcactccgacgcagtggatggagctggagcaccaggccctgatctacaagcacttcgctgtgaatgcccctgtgccgtccagcttgctcctccctatcaaaagaagcctcaatccatggagcagccttggctccagctcattgggatgggcaccatttcgttccggctctgctgatgcagaaccaggaagatgccgccgcacagatggcaagaagtggcggtgctctagagatgctgtcggggaccaaaaatactgtgagcgacacataaaacgtggttgccaccgttcaagaaagcatgtggaaggccgaaaggcaacaccgaccactgcagatccaaccatggctgtttctggtggttcattgttgcacagccatgctgttgcttggcagcagcagggcaaaagctcagctgctaatgtgactgatccattctcactagggtccaacaggtgaagtcacctgatcgtctgatcctgcattgttatactcatttctgccacttaagtttgtgaatttttattttctcaacatttttttctcgaacacgcaggagaactgtgcatcatatattaaaagaagtaaaaaagtctaaagaagaccaaaatctgccataagaggcagaaagagataggaagtgggaggggcaccagcacactatattttctcaacataaatgacaatctatggttgatacatgtgccagtctagcagtcagggttcaggacgtaccaaaacattgaaaatgttatatcctttagacattgaaattttgtccatagccattcatagttgaaaattttgttcttgatttctttcaactggtcagtgatttcttcatgtaacctgtcattgatgcattccatcttttgccccgtgcccattcctatatataagattttattattatgtttgtttgttcaaacaattatggtaagcatgtgcaaagaaaggcagtaggaagcactataaataactgaaatgatatggtacttatgtcagtacaaactttagagataggtgaattctgttcatgatgaccctttcaaattttgacgacttactatagtcagcagtgaaagaaaaacaggacagtgtttccttttccttccatgaacttgaaatgttgactctggtttgcaggaatttgctggataagcagaatctaggtgaccagttctctgtatccacttccatggactcctttgacttctcatcatcacattcttccccaaaccaagccaaagttgcattttcaccggtggccatgcagcacgaacatgatcagctgtatcttgtgcatggagccggcagctcagcagaaaacgttaacaagtctcaggatggtcagctgctagtctcgagggaaacaattgacgacggacctctgggcgaggtgttcaagggcaagagttgccagtcagcatccgcagacatcttaactgaccattggacttcgactcgtgacttgcgtcctccaaccggagtcctacaaatgtctagcagcaacacagtgccagcagagaatcacacgagtaacagtagctatctcatggcgaggatggcgaattctcagaccgtcccaacactccactgagtgttcatcaggctggtctttgttgggaccacaaaataactgaagccatgttgatgtcctgagtttgctgatactaggttttcagtcgagtcttgtaactcctgttttagagctgttatatgttcacgtcatgtcgcctttcattttcggttcattcagatgggtgttctaataatttctttccttcttacctgtgaaggatttgagttccaatctgagacgtgggtttgttctaacttggaggtatttatgaatattaggcacttctgattccaaaaaaaaaaaaaaaaaaagggcggccgctctagagtatccctcgaggggcccaagcttacgcgtacccagctttctgtacaaagtggtc

SEQ ID NO: 1038 - DNA, 1854 bp, Zea mays
attaattaatggccgccaccaagaaccctccaacccccacctgaccttctcttcctccctcccccgaccgcctgtctgtcctccgcgcatccgttctctatcgaaagggaggaggaggagcgcgcgggagtgggctgggggcccaccgatgctgagctcggcgtcctcggccggggcggccatggggatgggcggcgggtaccaacaccagccgctgccactgccgcagcgcggggcggcggccgcggtcttcaccgccgcgcagtgggcggagctggagcagcaggcgctcatctacaagtacctcatggccggcgtccccgtcccgcccgatctcctccgccccgccccccacgccgccgccttctccttcgccagccccgccgcgtcgcccttctaccatcaccaccaccaccacccgtccctgagttactacgcctactacgggaagaagctggacccggagccgtggcggtgccgccgcaccgacggcaagaagtggcggtgctccaaggaggcgcaccccgactccaagtactgcgagcgccacatgcaccgtggccgcaaccgttcaagaaagcctgtggaatccaagaccgcctcctcgccgccccagctgtccaccgtcgtcaccaccaccaccacccgggaggccgccgccgcgacgccccttgagtccctcgcgggggcggggggtaaggctcacggcctgtccctcggcggcggggctggctcgtcgcacctcagcgtcgacgcttcgaacgctcactttcgctatggcagcaagtaccctcttggagctaaatccgatgctggcgagctgagcttcttctcaggagcaccagggaactccaggggcttcaccattgattctccagcagataactcttggcactccctgccatccaacgtgcccccgtttacactgtccaagggcagagactctggcctcctgcccggtgcctactcctactcccacattgaaccaccgcaggtgctcggccaggtcaccatcgcctcgctgtcacaggaccaggagcgccaccagtcgtcgttcagcagcggcggggccggcgctggtggattgctggggagcgtgaagcaggagaaccagccgctgaggcccttcttcgacgagtggcctgggacgcgggactcgtggtcggagatggacgacgcgaggtccagtaggacctccttctcgacgacccagctctccatctccattccgatgcccagatgtgattgagaacgaagctcgtgcgcggccagtaggtggcgttgtcgcatgacgcgcacccagcatcgcgctcgctgctagcgagccaccgtcacccggtgattgatgccctcatcctagctatttgtttcgctgaatcgcattaagaacagaactctatgtaagagcaggatccttcctcatgtatcaatgggggcaatgaactccattctgtttctatggttgtagtaccgaccatgctttgtatttgttgtacccagaccgagaatgaaaaccgcccagtcgtcaggcgttatcgtctaaaaaaaaaaaaaaaaaagtgtattgtgtgctttccaggctgtgtaagatctgatggcgaatctgttactgcagtgtaggtgtgtagcatctgtggtatggtaccttttgttgtgctactgctactggatctggattgatgcaaaatctggtgctgccgtaggcccctcttccttttcaaaaaaaaaaaaaaaaaaatacatcttttttttatgataggaaaagaaatgagaagaacagaaaaaaaaaaaaaaaaaaaaaaaaaagggcggccgctctagagtatccctcgaggggcccgaagcttacgcgta

SEQ ID NO: 1039 - DNA, 1753 bp, Zea mays
gaaaaaaaaccatgtgcgtttgtttatatttcgggacgggagtagtcccgcgaggaaaaatccacggatgtgacaaacgatcaaaatgacagagcccgcagaggaatcagagaaaggaatcaaaggcgtgggtcaccggaaaaaaacttttttttttttttttttattttttttttttttttttttttttttttgacaaaagcgacaaagcttgcatcacagactggaactggaagaaatgaaaatgtcacacaaaaaaataaacaacatttggtacgagtaacgtactgctacaaaagaacaaaagaccaaatcatagagtccctagtactgcttgactcggttcagacttttttgagcctcagcccctgagccgtcccgcgcaaagcagcgcagaccgcagaggcagaagcagggtttgccgctacgagatgcatccacgtcactggcttactgctcgctgttgcaggcttgcattgcagccaggaaatgcagcggtcaatccacgctgttgcagggctgcagctaggagatggaccgatcactccccgttgtggaatcgcgcggcggcggcggaggcggaggtagcagcgaggtcggagggcgaagccgcggggatggagatggaaagctgcgtcgcgtcgtccgccgccatgtcgccgctctcccgcggccactcgtcgaagaaacgccgcaggggctgcttctcgtcggagccggtgtcgggctcgggcagcggcttgtcgaggctcaggtcggccccgagcgcgtggaagtgccgtcgcctgagctccttggactgcccgtagtcgtagtcgtagccgtagccgccgcccgggaagagcgacgacgctggcggtgtgtagtgggcgtacctgtggtaggacggcggcggcgatggcgacgccgccgccgcgtgcaggctcgcgtcgaggtggagctggagagcgccagcggggacgcgggctgctgctcctgctgcggaggaggcgccgtggaggagatgctgctgcgggtaggcgaggctcggcggcggcgcgtcggccgcgcggggcggcgagatggtggagatcgcggacggtcggtacgccgcagcggggccggcggcgggggaggaggtcacttccacaggctttcttgaacggctcttcccgcggtgaatgtgcttctcgcagtacttggagtcgccgtgggcctccctggagcaccgccacttcttgccgtccgtccgccggcaccgccccggctccgtgtcctccgccgccttgcggccgaacggcgcccccgcgccgtagcagccccagtacgccagcgacggcgaaggctgcggcgggaaggcgagggagggcgcggtgtcgacgccggtggcgaggcggagcggtaggacgaggtcgtgcggcacgggcgcgcccgaggccatgtacttgaagatgagcgcctggtgctcgagctcctgccactgcgacgccgtgaacaggcgcctcccgccgccgtgcccgctcagcatcatctcctcgagcccgcgttgcttggccgcactcgctcaacaatgcacgctcccgcagcgccgacgacgtacgaggcagagggcggcggcgccgagacctcgcttccagttacaagggaaatgagagatgggactgaaatggaggggtctccgatactagtagttctacaggtttgtgccggtgtcaggactcgggaacgggaagacgtggagcatcagctcgatacggcatgtacgaaagtttca

SEQ ID NO: 1040 - DNA, 751 bp, Zea mays
gagcctaagcaaaacggtctcatgttcacccacccacatgaggcgaggcggaggcggggagagacgacggccgccgccgcttggtttggtacacagatctgacacggaaaatgaccgacaaatatacaggagcatgggctgtttccgcagctactactgcgcggtgggtggaggactggagggaagacagacaaagggccagaacgcgacgatccacgcaccattagtcatcgttgggcgactgggagctggccacggagaagtcggaggacgccatgggtatggacatcgacagctgggtcgccggggggaacgaggcgaggctggcggtctcgtcggagaggcccggccaggagtcccgcgccttgggccactcgtcgaagaagtgccgcagcgtctggccctcctgcttcgcggaggcggagcccatggccatgccggccccggtgtcgttccctaggaaggacgagggcggctgctgagacgatccccccatcgacgaggagaacggggaggagatattgccggacccgccaactcctcctccaccaccagtgctgccggcgatggccgggtagagagagtggttctggaagccgctgccgttggtggtggcggcggcggcggctgccaggggcggagcggcggagacggctgcggcggcgggcggttgggactggggcgcgagctgcgtttccccaggctttcttgaacggttgcggccgcggtgcatgtggcgctcgcaatactt

SEQ ID NO: 1041 - DNA, 1042 bp, Zea mays
ggtacgcgtaagctctgggcccctcgagggatactctagagcggccgcaaccgttcaagaaagcctgtggaagcgcagctcgtgcccccgccgcacgcccagcagcagcagcagcagcaggcccccgcgcccaccgctggcttccagagccaccccatgtacccatccatcctcgccggcaacggcggcggcggcggcggggtaggtggtggtgctggtggcggtggcacgttcggcctgggccacctctcagctgcacatggacagtgccgctgcttacgcgactgctgctggtggagggagcaaaatacctaggtactctgcctacggggtgaagtctctgtcggacgagcacagccagctcttgcccggcggcggcggcggcatggacgcgtcaatggacaactcgtggcgcctgttgccgtcccaaaccgccgccacgttccaggccacaagctaccctctgttcggcgcgctgagcggtctggacgagagcaccatcgcctcgctgcccaagacgcagagggagcccctctccttcttcgggagcgacttcgtgaccccgaagcaggagaaccagacgctgcgccccttcttcgacgagtggcccaagtcgagggactcgtggcccgagctgaacgaggacaacagcctcggctcctcgggccacccagctctccatctccatccccatggcgccctccgacttcaacaccagctccagatcgccgaatggaataccgtcaagatgaacctgagtaaaccatgcggaccccaacgtctcagagctgacgactctttgctgctggcctggcctcatcgtaccttgaggcgtcaaggaatacttcattaccactagtatcatgctcctggattttcgaacaatatatatatgcttatgtaccgctatttctctcatcttttacacttctttacccgtttggaattgtatgttctgcgtggcacggttgtttatttgaccttttttggatttgattgaaagctccgtttcttgcttaaaaaaagaaaaaaaaaaaaaaaa

SEQ ID NO: 1042 - DNA, 399 bp, Zea mays
  misc_feature (214)..(215): n is a, c, g, or t
  misc_feature (385)..(385): n is a, c, g, or t
cactggggttcactcctcttgcgtgtgtgtggtttccttgcagttgggtacgggccctacttcggcaagaaggtggacccggagcccgggcggttgccggcgtacggacggcaagaagtggcggtgctccaaggaggccgccccggactccaagtactgcgagcgccacatgcaccgcggccgcaaccgttcaagaaagcctgtggaagcgcanncggcgcccccgccgcacgcccagccgcagcagcagcagcaggcccccgcgcccgctgctggcttccagaaccactcgctgtacccgtcgatcctcaccggcaacgcggcggcggggtaggtgctggtgctggtggtggcacgttcggcctggggccacctctcagctgcncatggacagtgccg

SEQ ID NO: 1043 - DNA, 785 bp, Zea mays
cggcggcggcgacgccgcgtgcaggctcgagtcgaggtggagctggagagcgccagcggcgtgggcgcggcctgctggagagagagcgccgtggcggagatgctgctgctgcgggtggccgaggcccggcggcggcggcggcgcgtcggccgcgcgaggcggcgagatggagaacgcggacgggcggtaggcggcgggggaggtcacttccacaggctttcttgaacggctcttcccgcggtggatgtgcttctcgcagtacttggagtctccgtgggcctccctggagcatcgccacttcttgccgtccgtccgccggcaccgcccgggctccgggtcctccgccttgcggccgaacggcgcccccgcgccatagcagccccagtacgccactgcgcgcgcggggcacgtacagactcgtcagcgacgacgactatctatcgacgatgagtgtaaaacacgagcgcgggaactcgatgagggaggggggaggagagaagcgcgcgggggcgtacgcgacggcgaaggctggggcgggaaggcgagggagggcgcggtgtcgacgccggtggcgaggcggagcggcaggacgaggtcgtgcggcacgggcgcgccggaggccatgtatttgaagatgagcgcctggtgctccagctcctgccactgcgacgccgtgaacaggcgcctcccgccgccgtgcccgctcagcatcatctcctcctcgagcccgctttgctcaacaacgaagaaggatgagagacagaggacgacggctccgagagctc

SEQ ID NO: 1044 - DNA, 1035 bp, Zea mays
tgaactatagaacaagtttagtacaaaaaagcaggctggtaccggtccggaattcccgggatggtttttgtgtctttttttgcttgccttttatcctgccctaggatcgtgtttaggaaacgcttgcatctcggcggtcatctctatgaagcagtacacatgtttttggctgcgccttgttggcttccaccgttttgctgctcatctctcctaactatgcctgcctgtttgctccccgcaggattgagctcggtgagcttgagcaccagcatgcagggggcaatggccagggtgagggccccattcacgccgtcccagtggatcgagctcgaacaccaggccctgatctacaagtacctggccgcgaacagccccatacctcacagcctcctcatccccatcaggaggagcctcgcagcgtctccctacccgccttcatacttcggcacgagcacattggggtggggctctttccagctgggctactccggcaatgcggatctggagcctgggcggtgccgccggacggacggcaagaaatggcggtgctccagggacgcggtcgccgaccagaagtactgcgagcgacacatgaaccggggacgccatcgttcaagaaagcatgtggaaggccagcctggccatgccgcgaaagccatgtccgcggtggcggcggcggctgctgctgctgcccagcctgctgctctggccggcgccggagctcctgctgctggcctcactgtcaatcagcaccagctgccggcgaagagctacgccacgggtgcgactgacccttgctctctgcaatataacagggaactggtgaacaaacagaatgagagcgaaaacatgcaggactccgacaacctctcgatgctgacttccatgaacacaggaaaacacagcagcgtgttcccattctcgaaacaaaacaccaatccttttgaagtgaccagctcaaggctagagttcggcctcgtttcatcggattcactgatgagttcccctcacagttccttggagaacgtcaacctg

SEQ ID NO: 1045 - DNA, 1467 bp, Zea mays
atggcgcagtcgaccgttggcagcctgagagccgttggcgcaccggacatgtccggtgcacaccggacagtccggtgccttcttctagccgttggctcggccaccgccccgtgcgcactggcgcaggcccagcgccagcggcagccggcaggtgccagccagcctgcttgcctgcctgcctgcgcagctgctcccgctggcggtgctgctgtccgctgctgctgctgccggccgctgcagctgtgcaagcgcacgcagattctgcagcgcgcactctgctctgcgcctgccctgaacactgaccgaagtgacccatcctctgcgccgactgcaccccacaccacccccccacctcagctcaccttgcgctgcccctgtgcctgctgcatgcctgacaccggcgccatatgcatgatagcggatgatgatactagcacgtcttcccgttcccgagctgcctctgacaccagcacaaacctggagactactactagtattggagtcccctccatttccacctcccttgccactgaagcgagagctctcggagccgtcgtcctctgtctctcatccttcttcgttgttgagcaaagcgggctcgaggaggagatgatgctgagcgggcacggcggcgggaggcgcctgttcacggcgtcgcagtggcaggagctggagcaccaggcgctcatcttcaaatacatggcctccggcgcgcccgtgccgcacgacctcgtcctgccgctccgcctcgccaccggcgtcgacaccgcgccctccctcgccttcccgccccagccttcgccgtcgcgggaggcccacggagactccaagtactgcgagaagcacatccaccgcgggaagagccgttcaagaaagcctgtggaagtgacctcccccgccgcctaccgcccgtccgcgttctccatctcgccgcctcgcgcggccgacgcgccgccgccgccgccgggcctcggccacccgcagcagcagcatctccgccacggcgctctctctccagcaggccgcgcccacgccgctggcgctctccagctccacctcgactcgagcctgcacgcggcgtcgccgccgccgtcctaccacaggtacgcccactcccacgctcactacacgccgccgccgccgccgtcgctctacgactacgggcagtccaaggagcttcgggaggcggcggagctcaggcggcggcacttccacgcgctcggggccgacctgagcctcgacaagccgctggccgacgccggggccgcggagaagcccctgcggcgtttcttcgacgagtggccgcgggagagaggcgacacgaggccgtcgtgggcgggggcggaggacgcgacgcagctctccatctccatccccgcggcttcgccctcctctgaccacgctgcctctgccgccgcgcgatgccacaacggttgctcctattggctgctgcaactgcaacgctag

SEQ ID NO: 1046 - DNA, 2300 bp, Zea mays
aaagcaggcttcgaccctagaaaaaatcgctaccactgcacccctcaaacccagtgacccaacccactacacatcggagtctcgcgcgcgggctcaagcacttgttcttagctgcttagctgctttcttcgttgtaggaactgcaacaatggctaccccctaccgtcttccttgctgctgctatgccctcgtcactgtgctcgtgctcttcttctccgtcgacgctacggagggcgccatcagggagtaccagttcgatgtgcaaatgaccaatgtgacgcggctgtgcagcagcaagagcatcgtgacggtgaacggccagttcccggggccgacggtgttcgcgagggagggcgacttcgtcgtcatccgcgtcgtcaaccacgtcccctacaacatgagcatccactggcacggcatccggcagctgcggagcgggtgggcggacgggccggcgtacatcacgcagtgcccgatccagagcggccagagctacgtgtacaagttcaccatcacggggcagcgcggcacgctgtggtggcacgcgcacatctcctggctgcgcgccaccgtctacgggcccatcgtcatcctgcccaagcccggcgtcccttacccgttcccggcgccctacgacgaagtccccgtcttgttcggggagtggtggacggccgacacggaggcggtgatcagccaggcgctccagaccggcggaggccccaacgtctccgacgccttcaccatcaacgggctgcctgggccgctctacaactgctctgcaaaagacacgttcaagctgaaagtgaagcccgggaagacgtacatgctccgcatcatcaacgctgcgctcaatgacgagctcttcttctccatcgccggccacccgctcaccgtcgttgacgtcgacgcggtctacatcaagcccatcaccgtggagaccatcattatcacccctgggcagaccaccaacgtgctcctcaccaccaagccgtcctaccctggcgccacctactacatgctggctgcgccctactccaccgccaggccgggcaccttcgacaacaccaccgtcgccggcatcctcgagtacgaggaccccacgtcgtcccctcccccgcacgcggccttcgacaagaacctcccggcgctgaagccgaccctgccgcagatcaacgacacgagcttcgtcgccaactacacggccaggctccgcagcctggccaccgcggagtacccggccgacgtgccgcgggaggtgcacaggcggttcttcttcacggtcgggctgggcacccacccgtgcgccgtgaacgggacgtgccagggccccaccaacagcagccggttcgcggcgtccgtgaacaacgtctccttcgtgctccccaccacggcgctgctgcagtcgcacttcgccggcaagtccaggggggtgtactcgtccaacttcccggccgcgccgctggtcccgttcaactacacggggacgccgcccaacaacaccaacgtgtccaacggcaccaagctggtggtgctgccgtacggcaccagcgtggagctggtgatgcagggcaccagcatcctcggcgccgagagccacccgctgcacctccacggcttcaacttcttcgtcgtcggccaagggttcggcaacttcgaccccgccaaggacccggccaagtacaacctcgtcgaccccgtcgagcgtaacaccgtcggcgtgccggcggccgggtgggtggccatccggttccgcgcagacaatccaggggtgtggttcatgcattgccacttggaagttcacgtcagctggggcctgaaaatggcatggctggtgctggacggagaacgccccaacgagaagctactgcctccgccatcggatctgcccacatgttagacgacacgaggaattgctggcctagtcgtcgccatcaacggccgtgattgatcggcccggaccatcttggaacagggattgcgtgctctctaatttgcacaggatatcttaccgtcttttgcttgtgctggggttggtgttatgcttccatttagtggtgtgctttttccggcttgagtcgtcgtctggttagctgtgtgagagacacgggcaggaaggtccgctgatgctactagacagacgccattttttttttttattacttatgagttactaccatcttttgtactgcctcggtcctaaaataattgacattcttgtttttaaaaaaaaaaaaaaaaaacggacgctcggggcggccgctctagagtatccctcgaggggccccaagcttacgcgtacc

SEQ ID NO: 1047 - DNA, 1362 bp, Zea mays
ccacgcgtccgcccggtgattcttacagctgcgagacgacggcgaagcgaatcgagaagttcgaggtgcgtcatgactccacctacatgctgcggattatcaacgctgcgctcaacacggcgttcttcctcaaggtggcagggcacacgttcaccgtcgtggcggcggacgccagctacaccacgcagtacgagacggacgtgatcgtcatcgcgccgggacagaccgtcgacgcgctcatggtggccaacgcgtcccctggccctggccgctactacatggcgatctcctcgtaccagagcgcggcccccctgcgcccagggagctacaacgctaacatcaccacggccgtcgtggagtacgtcggagcggcggcgtcggccggccagcaggcgccgacgccggcgctgcccgagatgccggaggtgaacgacacggccacggccaaccggttctacaccggcatgacggcgctcgtccgcccaggcaggcggaccgtgccgctcgccgtcgacacccgcatgttcgtcacgatcgggctgggcttcgtctcctgcgaccaggaccaggctccgtgcccggtcgtcgcgagcatgaacaaccagtctttcaagctcccagacgcagacaccatgtcgatgctggacgcgcggtaccgggacacgccggacggcgtgtacacgagggacttccccgaccagccgcccgtggcgttcgactacacgaaccagacggagcggctgctgctgggcggcgtcgccgcggcgctgctgttcccgggaccgcagtccacgaaggtgaggacgctggcgtacaacgcgacggtggaggtggtgctgcagaacacggcgctggtggggcgcgagagccacccgatgcacctgcacgggttcaatttcttcgtcgtcgcgcaggggttcggcaactacgacacggccgcgaagcagcacttcaacctcgtcaacccgcaggagcggaacaccatcgcggtgccgaccggcgggtgggccgtgatccgcttcgtagcggataacccaggaatgtggttcatgcactgccacatcgacgctcacctttccatcggcctggcgatggtgttcgaggtggaggacgggccgaacacaacgctgccggcgccaccgccggacctcccgcgatgctgatgagcctgtcccggtgtggcgcgcggtgcacgtacgtgtgccgtttatgtttcagccacggaaccaactgcatattatcacgatttgagtttgcgattgttcgagtgatgaaagtgtaaactacagccagtacgatgttcttttgcagcaccgttttgttttctattaattgaatgtgaaaaaaataaaaaagaaaatg

SEQ ID NO: 1048 - DNA, 1314 bp, Zea mays
atgccgcgctcttggatgatcctactgctagttttgtgttccgctgcagtcctcgctcaagctgctactgtggagcataccttcaatgtggcgacgatatcctggccgcgcatctgccagccggggaatgtaagcatcacggcggtggacggagtacccggtcccgtgatcgaagccaacgaaggcgacacggtgctggtccacgtcatcaaccactctccgctcaacgttacagtccactggcacggcgtcttccagctgggcacgccgtgggcggacggcccgtcgatggtgacgcagtgccccatctgcccgggccaccgctacacgtacaggttccgcatcacggggcaggagggcacgctgtggtggcacgcgcacagctccctcttgcgcgccacggtgtacggcgccctcatcatccgcccgagcagcgggagcgcctaccccttcccggcgccggacgaggaaaagaccgtccttctcggcgagtggtggaacgccgagaccgtccctctcaccaacccagtcgccgacgcgtacacaatcaacggaaggcccggtgattcttacagctgcgagacgacggcgaagcgaatcgagaagttcgaggtgcgtcatgactccacctacatgctgcggattatcaacgctgcgctcaacacggcgttcttcctcaaggtggcagggcacacgttcaccgtcgtggcggcggacgccagctacaccacgcagtacgagacggacgtgatcgtcatcgcgccgggacagaccgtcgacgcgctcatgagcgcggcccccctgcgcccagggagctacaacgctaacatcaccacgtccgtcgtggagtacgtcggagcggcggcgtcgggcggccagcaggcgccggcgctgcccgagatgccggaggtgaacgacacggccacggccaaccggttctacaccggcatgacggcgctcgtccgcccaggcaggcggaccgtgccgctcgccgtcgacacccgcatgttcgtcacgatcgggctgggcttcgtctcctgcgaccaggaccaggctccgtgcccggtcgtcgcgagcatgaacaaccagtctttcaagctcccagacgcagacaccatgtcgatgctggacgcgcggtaccgggacacgccggacggcgtgtacacgagggacttccccgaccagccgcccgtggcgttcgactacacgaaccagacggagcggctgctgctgggcggcgtcgccgcggcgctgctgttcccgggaccgcagtccacgaaggtgaggacgctggcgtacaacgcgacggtggag

SEQ ID NO: 1049 - DNA, 2215 bp, Zea mays
agaacaagtttgtaggaaaaagcgggctgggccgggtccgctaccactgcacccctcaaaccagtgatccacccacacatcggagtctcgcgcgcgggctcaagtacttgttcttagcttagctgctttcttcgttgtaggaactgcaacaataatggctaccccctaccgtcttccttggcgctgctatgccctcgtcactgcgctcgtgctcttcttctccgtcgacgctacggagggcgccatcagggagtaccagttcgatgtgcaaatgacgaatgtgacgcggctgtgcagcagcaagagcatcgtgacggtgaacggtcagttcccggggccgacggtgttcgcgagggagggcgacttcatcgtcatccgcgtcgtcaaccacgtcccctacaacatgagcatccactggcacggcatccggcagctgcggagcgggtgggcggacgggccggcgtacatcacgcagtgcccgatccagagcggccagagctacgtgtacaagttcaccatcacggggcagcgcggcacgctgtggtggcacgcgcacatctcctggctgcgcgccaccgtctacgggcccatcgtcatcctgcccaagccccggcgtcccttacccgttcccggcgccctacgacgaagtccccgtcttgttcggggagtggtggacggccgacacggaggcggtgatcagccaggcgctccagaccggcggaggccccaacgtctccgacgccttcaccatcaacgggctgcctgggccgctctacaactgctctgcaaaagacacgttcaagctgaaagtgaagcccgggaagacgtacatgctccgcatcatcaacgctgcgctcaacgacgagctcttcttctccatcgccggccaccagctcaccgtcgttgacgtcgacgcggtctacatcaagcccatcaccgtggagaccatcattatcacccctgggcagaccaccaacgtgctcctcaccaccaagccgtcctaccctggcgccacctactacatgctggccgcgccctactccaccgccaggccgggcaccttcgacaacaccaccgtcgccggcatcctcgagtacgaggaccccacgtcgtcccctcccccgcacgcggccttcgacaagaacctcccggcgctgaagccgaccctgccgcagatcaacgacacgagcttcgtcgccaactacacggccaggctccgcagcctggccaccgcggagtacccggccgacgtgccgcgggaggtgcacaggcggttcttcttcacggtcgggctgggcacccacccgtgcgccgtgaacgggacgtgccagggccccaccaacagcagccggttcgcggcgtccgtgaacaacgtctccttcgtgctccccaccacggcgctgctgcagtcgcacttcgccggcaagtccaggggggtgtactcgtccaacttcccggccgcgccgctggtcccgttcaactacacggggacgccgcccaacaacaccaacgtgtccaacggcaccaagctggtggtgctgccgtacggcaccagcgtggagctggtgatgcagggcaccagcatcctcggcgccgagagccacccgctgcacctccacggcttcaacttcttcgtcgtcggccaagggttcggcaacttcgaccccgccaaggacccggccaagtacaacctcgtcgaccccgtcgagcgtaacaccgtcggcgtgccggcggccgggtgggtggccatccggttccgcgcagacaatccaggggtgtggttcatgcattgccacttggaagttcacgtcagctggggcctgaaaatggcatggctggtgctggacggagaacgccccaacgagaagctgctgcctccgccatcggatctgcccacatgttagacgacacgaggaattgctggcctagtcgtcgccatcaacggccgtgattgatcggcccggaccatcttggaacagggattgcgtgctctctaatttgcacaggatatcttaccgtcttttgcttgtgctggggttggtgttatgcttccatttagtggtgtgctttttccggcttgagtcgtcgtctggttagctgtgtgagagacacgggcaggaaggtccgctgatgctactagacagacgccatttattttttattgattacttatgagttactaccatcttttgtactgcctcggtcctaaaataat

SEQ ID NO: 1050 - DNA, 2056 bp, Zea mays
aatggctggcatcgggcatctccactcccactccaccggccccacctccgcgaggggcgacccgagaacaccaccacgcccgccatgtggcgccgcctccaaaccctagccccctcgctccgccgcgccgccgcatcgtcgtccccggcctccgcccgcgccgtgcccttgtccacggtgccggtggccgcgttccggcgcacttcgaccctcctctcctctcccggcgacaagccggcgcccagcaaggtcgaggatgtcatgccgatcgccacggggctggagcgcgaggagctcgaggcggagctccaggggaagaagcggtttgacatggatcctgccgtcagccccttcggtactaagattccgttttcttcgtcgtatttgtatttgctgcttcattgaatgtgcatgctgcttggttcccaataaaaactgaagcagtgcgtttgtttattctctctgcatggctgcatgctcctctcccaaacgttcaccttggcacaagagacgatgcataccggatagaaataactcattccttggtcactgtgctcgactactataagatggagattttagaaaggagggagtatgtctatattcaatggataatgaatttagacacatatccattacctagaacatcctaatcgaaaatgtagtatctgttcctactgcttgatttattgacaggaactcttttgtgtatgttacgtggaaacttgaaagttttactgttgtatgacccatttatcaattgttgtgtgcagattaaacttgtgctaagcacaagtaatgacacaatatttcactccagtatggacatggctttaagtaaaaaagacccaccagatacatctcttgttactgatattaatatcgtaaactacaaagtatttgatatgtgcatgcttaagctgcattacctgaagcttgtttcaaatacaccagcagtcagccagccgtacatgaaattcgtagggtatgtttataactgccttgtcacttgggagcattgcgttaaatatcagtgtttgatgtatctggtgcttctattcttcaaccgtaggcatgccctcacatccatgctgagtactgacattgcctgtatttggtctagatatgtgttgaagttcttgaccactcacttcccttctgttttttttctttccagacttcctatgctgcaagatctcaattgttctggacaatataaagtactaccttaagaaaacaagtataataccaaaaaaacactaaacaacaggggcacacttttcacttgtttgtggttatgctattcctaaattttctaattttcaatcaattgatgcacccagcttctatgcataccctgtgctgactactgacattgtgtgcgcttttagtgaagagatgtaggatttcttgatcactctctccccttggttttgcataccactctttgtgctgcaagattgtccatttgttaattttgaatgtattgtctgcacgaggaatcagccgtgattgaatcctactataacaagagaatagttggctgccctggtgccgaaggaggtacatcaaggctaacaatatatgtcagtacctagtgttgagtatgtaactcaccataactgtgcttatttttccatcgtgcttattgcagaggatgaacacgatgtcgtctggttttggttggaaaaggataaaccgcatgagtgcctagtctgctcacgctcaaggtcattggtgatgggggtgatccagatggccacgatgacgaggatgatcatcactgaggccttgtgtcgataatgataataagaactttgtgaaacatggttttgtcctatctttgcagcatcagactgccctatagagtattgtaattgataagtgtttgaccatgaaccaggtcgggtggtgttttacacctacgaattttgttcagatcttttcgaccatacggttgcttctgtttggaatatagattttttttttctggagtgcaacatcaaataaaggatgagtgcatcggtttcactctaacaaaaaaaaaaaaaaaatc

SEQ ID NO: 1051 - DNA, 1165 bp, Zea mays
gtgacactatagaacaagtttgtacaaaaaagcaggctggtaccggtccggaattcccgggatatcgggcatctccactcccactccaccggccccacctccgcgaggggcgacccgagaacaccaccacgcccgccatgtggcgccgcctccaaaccctagccccctcgctccgccgcgccgccgcatcgtcgtccccggcctccgcccgcgccgtgcccttgtccacggtgccggtggccgcgttccggcgcacttcgaccctcctctcctctcccggcgacaagccggcgcccagcaaggtcgaggatgtcatgccgatcgccacggggctggagcgcgaggagctcgaggcggagctccaggggaagaagcggtttgacatggatcctgccgtcggccccttcggtactaagattaaacttgtgctaagcacaagtaatgacacaatatttcactccagtatggacatggctttaagtaaaaaagacccaccagatacatctcttgttactgatattaatatcgtaaactacaaagtatttgagatgtgcatgcttaagctgcattacctgaagcttgtttcaaatacaccagcagtcagccagccgtacatgaaattcgtaggccgtgattgaatcctactataacaagagaatagttggctgccctggtgccgaaggagaggatgaacacgatgtcgtctggttttggttggaaaaggataaaccgcatgagtgcctagtctgctcacggtactttgtgctcaaggtcattggtgatgggggtgatccagatggccacgatgacgaggatgatcatcactgaggccttgtgtcgataatgataataagaactttgtgaaacatggttttgtcctatctttgcagcatcagactgccctatagagtattgtaattgataagtgtttgaccatgaaccaggtcggggggtgtttttacacctacgaattttgttcagatcttttcgaccatacggttgcctctgtttggaatatagattttttttttctggagtgcaacatcaaataaaggaggagggcatcggtttcaaaaaaaaaaaaaaaaaaaaaaaaaaaaaaaaaaaagggcggccgctctagagtatccctcgaggggcccaagcttacgcgtacccagctttc

SEQ ID NO: 1052 - DNA, 1674 bp, Zea mays
atgggctgcgtcttcggccgggcggctgcgtcgtcctctgcagcgccgaagaagaagtggggcaaggggaggtcgtccccgcagcccgaagcggggtcgccctccgcagtcgccgccaccgacggggacgggaggccgcggcggcggctcgggggccgcagggcgtcgggacccaggcagggttgcgtccccgcggctgccgcggcggagcagctcgccgccggttggccaccgtggctcgttgcagtcgctggggaggccctccgcggctgggcgccgcgccgcgccgacacgttcgagaagcttaataagataggatcgggcacgtacagcaacgtgtaccgggcgagggacaccgtctctggccggatcgtcgctcttaaaaaggtccgcttcgataacctcgagccagaaagcgtcaagtttatggcccgggaaatactgatcctaaggagactcgaccaccccaacatcatcaaattagagggcttggtcacctccaggatgtcatgcagcctttaccttgtcttcgagtacatggagcatgatcttgctggtcttgcggcaagttgtgatgtcaagttcacgttgcctcagataaaatgttacatacagcagctgttgtcagggcttgagcattgtcatgacaataatgtattgcaccgggatatcaaggggtcaaacttgttgttggataataatgggattcttaagattgcggattttgggctggcaacattctttgatccacgacataaacgaccaatgacgagccgagtggtcacgctatggtaccgtccaccagaattgttacttggtgccactgagtatagtgtaggtgttgatttgtggagtgctggatgcattcttgcagagctcctgtatggaaagcccataatgcctgggcgcactgaggtggaacagttgcacaagattttcaagctatgtggttccccttctgaggagtactggaagaagtctaaattgccacacgcaacaatattcaaacctcaacaaccctataaacgttgcatcagggagacatttaaagattttcctacatcggctctgccattggttgaaactctgcttgcaattgatccagctgagcgacaaactgcctcagctgcattacacagtgattttttttcaaccgagccttatgcttgtaacccttcaagtctgccaacatatccaccaagcaaggagatggatgccaagttaagagacgaggaggctagaagactacgagcggctgcaaaggccaagggagaacagaaaaggactcgaccacgtgatcgatctcggagggctggaccagcaccagaagctaatgcagagattcaagcaaacttagaccagaggcgacgaatgataactcatgcaaatgcaaagagtaaaagtgagaagtttcctcctccgcatcaggatggaggtacgggtaatccgcttggatcctatcatcatatggagcctatgttcgagcaccaggatgcttccttcagtacagtagtccccatagagaaggggacctcacaaacatggtccgggccgttgtttgatccagcagctctcgggcagtcgaggcggaagaagcaaactaccctagatgctaaggctgctgcttactcaaagcagctccaaaaggaaaagggagggatacgagcccgataa

SEQ ID NO: 1053 - DNA, 1920 bp, Zea mays
atggacgagcccccgtgcccgcccccgcggcccgcgctcaactccgccgccgcgacgtcatggccggagctgctcgcgccgttcgacctctcccgcctccgcgccacgctgtcctcgcacccgctcaccccgcgccgcctggcccgcctcctcgcgctcccgctcgcgccggccacctccctgctcctcctcgactggtacgcgtcgtcccacccggcgctctcgctctcgtccctcccgctccgccccatcctcgcggcagccgaccccgaccgcgcgctcgcgctcctcgactccctgccggcctcccgcctgcccccgctccgcgagtccctcctgctcccgctgctccgctccctgccacccggccgcgcgctccacctgctcgaccagatgccccgccgcttcgccgtctccccctccttccgctcctacaacgtcgtcctctccacgctcgccagggccgactgccacgccgacgccctgctcctgtaccgccggatgctcagggaccgcgtgccgccccaccaccttcaccttcgggcggggtcgccgaggcccgcgatgctcctcgacgagatgttactcatggggtgtgcggcggacgtgaacaccttcaacgacctggtgctcgggctgtgcgggctcgggcgcgtgcgagaggcagccaggctggtggacaggatgatgacgcagggatgcatgccaagtgtggtgacatatgggttcctcctgcaagggctgtgccgaacaaggcaggcggacgaggcgtgcgccatgctcgggaggttgccggaggtgaacgtggtgatgcttaacacggtgatccgtggatgtctgacggaggggaagctggccagggcaacagagttgtatgagatgatgggttcaaaaggatgcccgcctgatgtgcacacatacagtattttgatgcatggcctttgcaagcttgggagatttggttcagcagtgcggatgcttgatgagatggaggagaagggttgtgcaccaaatatcgtgacctactctaccttgctgcattcattttgcaggaatggcatgtgggatgacgcaagagcaatgctggatcagatgttagccaagggctttagtatgaactcccaaggatacaatggtatcatatatgccttatgcaaggatggcaagcttgatcaagcgacaaggcttgtccaagagatgaagagtcaggggtgcaagcctgatatttgcacgtacaatacaatgatttatcatctgtgcaacaatgacctgatggaggaggcagaacatattttcagaaacttaattgaagagggtgttgttgccaatggaataacttataatactctcattcatgcacttctgcgcaacggaaggtggcaggagggcctaaggcttgcaagtgaaatgctacttcatggttgccagctagatgttattagctacaatggcctgattaaagccctctgcaaagaggggaatgttgatcggagtatggcgttgcttgaggaaatggtgacaaagggaattaagccaaataatttctcgtataacatgctgatcaatgaactctgcaaggcgggaaaggtacgtgatgcactggagctctcaaaggagatgctgaatcaaggactgacacctgacattgtgacttacaatacactcataaatgggttatgcaaagtgggatggacacatgctgctttaaatcttttagagaagctacccaacgaaaatgtgcatcctgacattgtgacatacaacattctcattagttggcactgcaaagtcagattgcttgatgatgccgctatgcttctagacaaagcaataagtggaggaatagttcctaatgagcgaacgtggggaatgatggtgcaaaattttgtcagacagacagtcaatctcgagggttactaa

SEQ ID NO: 1054 - DNA, 333 bp, Zea mays
atggcgttgcttgaggaaatggtgacaaagggaattaagccaaataatttctcgtataacatgctgatcaatgaactctgcaaggcgggaaatgtatgtgatgcactagagctctcaaaggagatgctgaatcaaggactgacacctgacattgtgacttacaatacactcataaatgggttatgcaaagtgggatggacacatgctgctttaaatcttctagagaagctacccaacgaaaatgtgcatcctgacattgtgacatacaacattctcattagttggcactgcaaagtcagattgcttgatgatgcctcgcacccaccgccgtaa

SEQ ID NO: 1055 - DNA, 599 bp, Zea mays
ttgggtacctcgaggccggccgggaaaacattctccttcttgaactcaaggagatggctctcgggaagaggcagtgcagtggttctactactttgcttcttgctgcttcactctcagatggctcgtgctgccacctacacagttggagattctgggggttggacctttaacactgttgcctggcccaaaggaaagctctttcgggctggtgacacacttgctttcaattatagccctgggactcacaatgtggtggccgtgaacaaggctggatatgatagctgcaagactccaagaggagccaaagtgtataagtcagggacggatcagatcagacttgccaagggacagaactacttcatctgcaattatgttggtcactgcgagtctgggatgaaaattgccatcaacgctgcctgagtttaataatatggttaacttcccatacatattgtattgtaatgcaaattgcaccctttagtgggaagttagctcctttaaataatgttaagaaaaaaagtagctatgtgtgctcttctataaatgtcacttatctataaagaataaatgccgacaaaaaaaaaaaaaaaaaagcggcc

SEQ ID NO: 1056 - DNA, 1053 bp, Zea mays
ataaaggggcattggcttgggatcacctctgcatctcgcctgggatctgctagcttgatctctcctagtcctagcccattcgcttctcctgttcgtcgctcttaatttgcttgctcgatccctggcagtggcagctgctgcaatggcttccggtggcgcgtcgtcactggccttggcttggcgcgctgctcctcgtgagctgcgcctcggcggcggtggcgaccaagtacaccgtcggggacgcgtccggctggacgaccaccggcgactacgccacctgggccagcggcaagaagttcaaagtcggcgacagtctcgagttcaaatacgccggcggggcgcacacggtggacgaggtgagcgcggcggactacgccgcctgctcctccagcaacgcgctcagcaccgacagcgccggcgccacgaccgtgaccctcaagacggccggcaagcactacttcatctgcggcgtggcgggccattgcagcagcggcatgaagctcgtggtggacgtggccaaggcggtgaccgccccggcgccggccccagccgcggccccggccccggccgcggacacagccccagatgcccccgacaccacgccgtcgaccccgacgtccccctcgagctccggcggccgcacgcccaagagcccagacacgacggtcctgtcgccgccggacaagaagtccacctcctccggcgccaccgggctcagcgccgcggcgtgggccggcttgggcctggccgggctcgtggccgtgcacctcggcgcgttctaggccagcccgctggcctggccagggaggagacagtgccgtgtgttgttgttaggctgcacgtcatggattggattggtgtattggttgagggacttgactgcttaccagagagagatctctttttggttcagggaacttattgacgatgctttggctgtgctgtagacatgtagttggataccttggatgttatgctatcagttttgctgttgctaaaaaaaaaaaaaaaaaaaaaaaaaaaaaaaaaaaaaagaaaaaaaaaaaaaaaaat

SEQ ID NO: 1057 - DNA, 1148 bp, Zea mays
gtaggatcgagggagagggagagcggccaagcgtggaccaacgactcctcttctccgatcctcccgcagctgcaggccgtagctagctctataaaaagctaagggagcctgcctgccatcgtcgtgcatcgtcatccaccacgatcgataaagctaattaagctgctactgctacgctagcctcgatcgatcaagcaagcagctcacagacccaccggcccacccacccacccacatggcggcgtcccgttccgctctgatcacgctgctcgtccttgtgagctccgtcgcggcggcctcggcgaccacgttcaccgtcggcgacagtagcggctggagtcgtagcgtcaactacgacaactgggccagtggcaagaccttcacggatggagatcagctagtgttcaacttcgccaccgggaaccacgacgtggtggaggtggacaagagcggatacgacggctgctccaccaccaacgccgccaacacaatccaaaacggcccggccaccgtcaacctcacctccggcacccactactacatctgcggcttcaccggccactgcagcgccgggatgaagctcgctgtcaccgtcggctccggctccggctccgggtcccccacccccggcggcggctcgcccagcacacccacaccaaccaccccgagcgcccccacccccgacactccggccagcgcgtccgtgcgcctcacggccggcccagcgctcgccgtggccgccaccgtgctcgtcgccctcttctgatctgatctgatctgatactgcatgcatgcaccgtgccaggaccaggatagaggcagtgcaggatcatagtattcttgtgtacgtacgtacatactttgttgttgagctagcgttttcattctgacgacggcggattattgtactctcgtacgtttttatttccacatgtactactgtctatcattcatgcttccaattcttcattgttaatttgttgcctgtggtgtgtatcatcatatattcatacgcaaagtacttaccaagcatatggtgctaattggtccaaaaaaaaaaaaaaaaaaaaaaaaaaaacttaaaaaattaaaaattaaaacaaaatttattttaaaaaataaaatagaaataaaaaaaaaatgggggg

SEQ ID NO: 1058 - DNA, 912 bp, Zea mays
cctcgaggcggacgcgtgggcgggtgtgcatagcagcaaatagtggttggcctgttggtactctatatcgtcccttccagtgtacccgtcctccagcccattatacatcatacttgctccagataagaccaagagcgtcatggccaacgccttgcctctcatcgtcgcgctggtcgccgccgccgggtgcgcggcgctggcttcggccacgtcgtacaccgtcggcgactcgcagggctggacgacaaccggcgtcgactacagcagctgggccagccgcaacactttcgtcgtcggagacacactagtgttcaactacgtgagcaaggcgcacacggtgacggaggtgagcaaggccggctacgacgcctgctccggcgccaacgcgctcagcgacgacgacaccggctccaccaccatcacgctccagaccccgggcacgcactacttcatctgcaacgtccccggccactgcgccagcggcatgaagctagcggtcgccgtctccgcctcgccctcgggcacggccccttccaccggagccctgcaggttccggcgatggcatccgtcgtcgccgcggccgcgggcgctgccatcaagctcgcgctcttctgacggagcacggccgggtcgtctcaggggagagacagtgcatgcagactacgttcttggcggttcatagttttccgctggcgattgttcgccgcgcagttcatgtatgtagtgtatgcatgtgtgtatgctactctgcggtggcgagtgctttttctgatgcctctgtcgttgtgtgttcatcaccgtcgtgtgcgattgttctttgggttgtctttgcctcaataaaactgcttcattctccagtattctataaaaaaaaactatgtactctgtacaacatagaacagagtacaaaa

SEQ ID NO: 1059 - DNA, 1032 bp, Zea mays
aatcttacctgggatctgctagcttgatctctcctagtcctagcccattcgcttctcctgttcgtcgctcttaatttgcttgctcgatccctggcagtggcagctgctgcaatggcttccggtggcgcgtcgtcactggccttggccttggccgcgctgctcctcgtgagctgcgcctcggcggcggtggcgaccaagtacaccgtcggggacgcgtccggctggacgaccaccggcgactacgccacctgggccagcggcaagaagttcaaagtcggcgacagtctcgagttcaaatacgccggcggggcgcacacggtggacgaggtgagcgcggcggactacgccgcctgctcctccagcaacgcgctcagcaccgacagcgccggcgccacgaccgtgacccagccgcggccccggccccggccgcggacaccgccccagacgcccccgacaccacgccgtcgaccccgacgtccccctcgagctccggcggccgcacgcccaagagcccagacacgacggtcctctcgccgccggacaagaagtccacctcctctggcgccaccgggctcagcgccgcagtgtgggccggcttgggccttgccgggctcgtggccgtgcacctcggcgcgttctaggccagcccgctggcctggccagggaggagacagtgccgtgtgttgttgttaggctgcacgtcatgaattggattggtgtattggttgagggacttgactgcttaccagagagagatctctttttggttcagggaacttattgacgatgctttggctgtgctgtagacatgtagttggataccttggatgttatgctatcagttttgctgttgttaaaaaaaaaaaaaaaaaaaaaaaaaaaaaaaaaaaaaagaaaaaaaaaaaaaaaacgcttgtaggtacgggccacctcggggggggggcccggcacccgattccccctaatgtggagtcaaatacccgggccaaggggcccgtcgttttacaacattgtggacggggaaaccccggg

SEQ ID NO: 1060 - DNA, 1716 bp, Zea mays
atggcgtcgtcgtcctcgtcccggctgctgctcctcctcctcccgtgcctcgcgctcacgctgctcggcgcggcagacgccgaagtgcaccaccacgagttcgttatccaagagacgccggtgaagaggctgtgcaagacgcacaacatcatcacggtgaacgggcagtacccggggccgacgctggaggtcagggagggtgacacgctcgtcatcaacgtcgtcaaccgggcgcagtacaacgccaccatccactggcacggcatccggcagataaggactgggtgggcggacgggccggagttcgtgacgcagtgccccatcaggcccggcggcagctacaagtaccggttcaccatccaggggcaggagggcacgctgtggtggcacgcgcacagctcctggctcagggccaccgtctacggcgcgctcatcatccgccccagggagaacaagacctacccattcgccaagccctcgcgagaagtccccgtcatcctcggtgagtggtgggatgcgaacccgatcgacgtcatccgggaggcgcagaggaccggcggcggtcccaacgtctccgacgcgttcaccatcaacggccagcccggcgacctgtacaaatgctccaacaaagagactacggccatcccggtggaggccggcgagacggcgctgctgcggttcatcaacgccgcgctcaaccacgagctgttcgtcaccatcgcgcagcacaagatgacggtcgtcgccaccgacgcgtcctacaccaagcccttcaccacctcggtgctcatgctcgcgccgggccagaccaccgacgtcctcgtcaccatggaccagccgcccacccgctactacgtcgccgcgcgcgcctacgtctccggccagaacgtggccttcgacaacaccaccaccacggccgtcctcgagtacgactgcggctgcgcctccgacttcggccccaagatacagccggcgttcccggcggcgctaccggccttcaacgacacgtccgccgccaccgccttcgccgccgggatcaggagccccgaccgggtcaaggtccacgagaacgtcgacgagtacctcttcttcaccgtcggcctcggcctcttcaactgcaagccgggccagctctgcgccgggcccaacaacaacacccgcttcgcggccagcatgaacaacgtctccttcgtcttcccgcagaccgactccctcctccacgcgcactactacaagatccccggcgtcttcaccaccgacttcccggcatacccgccggtgcagttcgactacacggggcagaacgtcagccaggccctgtggcagccggtccccgccaccaagctgtacccgctcaggttcggctccgtggtgcagctcgtcctgcaggacaccagcatcgtcacgcccgagaaccaccccatccacatccacggctacgatttcttcatcctcgccgagggcttcggcaacttcgaccccaagaaggacgtcgagaagttcaactacgtcgacccgccccagaggaacaccgtggcggtgcctgtcaacggttgggcggtcatccagttcgtcgccgacaacccaggtgtgtggctcatgcattgccatctggacgtgcacatcacctggggcctggcaatggctttcctagtggaggacggctatggcgaactgcagtcgctggagccgcccccagttgatcttcccatgtgc

SEQ ID NO: 1061 - DNA, 1950 bp, Zea mays
atgacatcgccgtcctcgtcgtcgtcctggctgctgctgctcctctcgtgcctcgcgcttgccctgctcgcggcggacgccgaagtgcaccaccatgagttcgttgtccaagagacgccagtgaagaggctgtgcaagacgcacaacgtcatcacggtgaacgggcagtacccggggccgacgctggaggtcagagagggcgacacgctggtgatcaacgtcgtcaaccgggcgcagtacaacgtcaccatccactggcacggcatccggcagatgaggaccgggtgggcggacgggccggagttcgtgacgcagtgccccatcaggcccggcggcagctacaagtaccggttcaccatcgaggggcaggagggcacgctgtggtggcacgcgcacagctcctggctcagggcaaccgtctacggcgcgctcatcatccgccccagggagaacaagacctaccccttcgccaagccctcgcgcgaagtccccgtcatccttggggagtggtgggacgcgaacccgatcgacgtcatccgggaggcgcagaggacgggcggcgcccccaacgtctccgacgcgttcaccatcaacggccagcccggcgacctgtacaaatgctcccagaaagagactacggccatcccggtgaagcccggcgagacggcgcttctgcggttcatcaacgccgcgctcaaccacgagctgttcgtcaccatcgcgcagcacaggatgacggtggtcgccaccgacgcgtcctacaccaagcccttcaccacctcggtgctcatggtcgcgccgggacagaccaccgacgtcctcgtcaccatggaccaggcgcccgcccggtactacgtcgccgcgcgcgcctacgtctccgggcagaacgtggcgttcgacaacaccaccaccacggcggtcctcgagtacgactgcggctgcgcctccgacttcggccccaagatccagccggcgttcccgtccctcccggccttcaacgacaccgccgccgccgccgccttcgccgcggggatcaagagccccggcagggtcagggtccacgagagcgtcgacgagcacctcttcttcaccgtcggcctcgccctgttcaactgcgagccgggccagctctgcgccgggcccaacaacagcacccgcttcacggccagcatgaacaacgtctccttcgtcttcccgcggaccgactccctcctccacgcgcactacttcaagacccccggcgtcttcaccaccgacttcccggcgcacccgccggtgcagttcgactacacggcgcagaacgtcagccaggccctgtggcagccggtccccgcgaccaagctgtacccgctcaggttcggctccgtggtgcagctcgtcctgcaggacaccagcatcgtcacgcccgagaaccaccccatccacatccatggctacgatttcttcatcctcgctgagggctttggcaacttcgaccccgagaaggacgtcgacaagttcaactacgtcgacccgccgcagcggaacaccgtggcggtgcccgtcaacgggtgggcggtcatccagttcgtcgccgacaacccaggtgtgtggctcatgcactgccatctggacgtgcacatcacctggggcctggcaatggctttcctagtggaggacgggtatggagagctgcagtccctggagccgcccccagttgatcttcccatgtgctaatgctgagcagaagcaactgtgttgaggaatcgaaagcatgttcacgcttccagcttgttttgaagttttcccctgtaaatctatgtaattttcaatgacattcagcatattattagagaataaattatttctttttgtgtatgatcaaaaaaaaaaaaaaaaaaaaaaaaaaaaagggcggccgctctagagtatccctcgaggggccccgagcttacgcgtacccgagctttc

SEQ ID NO: 1062 - DNA, 2021 bp, Zea mays
atcgcaaactcggaaaccttgagaggaaagccaccagcagcaagcgaagaccaccagcagcagcgcagcggcgacgtgtttcgctctcgccatggcgtcgtcgtcctcgtcccggctgctgctcctcctcctcccgtgcctcgcgctcacgctgctcggcgcggcagacgccgaagtgcaccaccacgagttcgttatccaagagacgccggtgaagaggctgtgcaagacgcacaacatcatcacggtgaacgggcagtacccggggccgacgctggaggtcagggagggtgacacgctcgtcatcaacgtcgtcaaccgggcgcagtacaacgccaccatccactggcacggcatccggcagataaggactgggtgggcggacgggccggagttcgtgacgcagtgccccatcaggcccggcggcagctacaagtaccggttcaccatccaggggcaggagggcacgctgtggtggcacgcgcacagctcctggctcagggccaccgtctacggcgcgctcatcatccgccccagggagaacaagacctacccattcgccaagccctcgcgagaagtccccgtcatcctcggtgagtggtgggatgcgaacccgatcgacgtcatccgggaggcgcagaggaccggcggcggtcccaacgtctccgacgcgttcaccatcaacggccagcccggcgacctgtacaaatgctccaacaaagagactacggccatcccggtggaggccggcgagacggcgctgctgcggttcatcaacgccgcgctcaaccacgagctgttcgtcaccatcgcgcagcacaagatgacggtcgtcgccaccgacgcgtcctacaccaagcccttcaccacctcggtgctcatgctcgcgccgggccagaccaccgacgtcctcgtcaccatggaccagccgcccacccgctactacgtcgccgcgcgcgcctacgtctccggccagaacgtggccttcgacaacaccaccaccacggccgtcctcgagtacgactgcggctgcgcctccgacttcggccccaagatacagccggcgttcccggcggcgctaccggccttcaacgacacgtccgccgccaccgccttcgccgccgggatcaggagccccgaccgggtcaaggtccacgagaacgtcgacgagtacctcttcttcaccgtcggcctcggcctcttcaactgcaagccgggccagctctgcgccgggcccaacaacaacacccgcttcgcggccagcatgaacaacgtctccttcgtcttcccgcagaccgactccctcctccacgcgcactactacaagatccccggcgtcttcaccaccgacttcccggcatacccgccggtgcagttcgactacacggggcagaacgtcagccaggccctgtggcagccggtccccgccaccaagctgtacccgctcaggttcggctccgtggtgcagctcgtcctgcaggacaccagcatcgtcacgcccgagaaccaccccatccacatccacggctacgatttcttcatcctcgccgagggcttcggcaacttcgaccccaagaaggacgtcgagaagttcaactacgtcgacccgccccagaggaacaccgtggcggtgcctgtcaacggttgggcggtcatccagttcgtcgccgacaacccaggtgtgtggctcatgcattgccatctggacgtgcacatcacctggggcctggcaatggctttcctagtggaggacggctatggcgaactgcagtcgctggagccgcccccagttgatcttcccatgtgctagtggaggacggatatttgtgttgaggaagaaagcctgttcacgttgtatgttaattgttactcttttttggtggaggggggcgtgttcgtgatcttaaattcttaggggacttgattttccagcttgatttgaagtttcttctgtaaatctatgtaattttcaattaatgacattcagcatattatttgagaataaattatttctttgtacg

SEQ ID NO: 1063 - DNA, 2095 bp, Zea mays
atggcgtcgtcgtcctcgtcccggctgctgctcctcctcctcccgtgcctcgcgctcacgctgctcggcgcggcagacgccgaagtgcaccaccacgagttcgttatccaagagacgccggtgaagaggctgtgcaagacgcacaacatcatcacggtgaacgggcagtacccggggccgacgctggaggtcagggagggtgacacgctcgtcatcaacgtcgtcaaccgggcgcagtacaacgccaccatccactggcacggcatccgccagataaggactgggtgggcggacgggccggagttcgtgacgcagtgccccatcaggcccggcggcagctacaagtaccggttcaccatccaggggcaggagggcacgctgtggtggcacgcgcacagctcctggctcagggccaccgtctacggcgcgctcatcatccgccccagggagaacaagacctacccattcgccaagccctcgcgagaagtccccgtcatcctcggtctgcaccctgctcatcctggcccgttaatttgttgtttcattcacgtctctaataatctaacggacggtgatcgatgggcaggtgagtggtgggatgcgaacccgatcgacgtcatccgggaggcgcagaggaccggcggcggtcccaacgtctccgacgcgttcaccatcaacggccagcccggcgacctgtacaaatgctccaacaaagagactacggccatcccggtgaaggccggcgagacggcgctgctgcggttcatcaacgccgcgctcaaccacgagctgttcgtcaccatcgcgcagcacaagatgacggtcgtcgccaccgacgcgtcctacaccaagcccttcaccacctcggtgctcatgctcgcgccgggccagaccaccgacgtcctcgtcaccatggaccagccgcccacccgctactacgtcgccgcgcgcgcctacgtctccggccagaacgtggccttcgacaacaccaccaccacggccgtcctcgagtacgactgcggctgcgcctccgacttcggccccaagatacagccggcgttcccggcggcgctaccggccttcaacgacacgtccgccgccaccgccttcgccgccgggatcaggagccccgaccgggtcaaggtccacgagaacgtcgacgagtacctcttcttcaccgtcggcctcggcctcttcaactgcaagccgggccagctctgcgccgggcccaacaacaacacccgcttcgcggccagcatgaacaacgtctccttcgtcttcccgcagaccgactccctcctccacgcgcactactacaagatccccggcgtcttcaccaccgacttcccggcatacccgcccgtgcagttcgactacacggggcagaacgtcagccaggccctgtggcagccggtccccgccaccaagctgtacccgctcaggttcggctccgtggtgcagctcgtcctgcaggacaccagcatcgtcacgcccgagaaccaccccatccacatccacggctacgatttcttcatcctcgccgagggcttcggcaacttcgaccccaagaaggacgtcgagaagttcaactacgtcgacccgccccagaggaacaccgtggcggtgcctgtcaacggttgggcggtcatccagttcgtcgccgacaaccctggtgtgtggctcatgcattgccatctggacgtgcacatcacctggggcctggcaatggctttcctagtggaggacggctatggcgaactgcagtcgctggagccgcccccagttgatcttcccatgtgctagtggaggacggatatttgtgttgaggaagaaagcctggtcacgttgtatgttaattgttactcttttttggtggaggggggcgtgttcgtgatcttaaattcttaggggacttaattttccagcttgttggtttgaagtttcttctgtaaatctatgtaattttcaatgacattcagcatattatttgagaataaattatttctttgtaacaaacaaaaaaaaaaaaaaaaaaaaagggcggccgctctagagtatccctcgaggggcccaagcttacgcgtacccagctttc

SEQ ID NO: 1064 - DNA, 1142 bp, Zea mays
ctatagaacaagtttgtacaaaaaagcaggctggtaccggtccggaattcccgggatcgatggtcgaattcgaaggttcgaaacctagctagtcgaccgaacaaacacccacaggccgtagcggggacgccatggagcgagagcctgcgcgctccctggaacgcgctatatatgccgtgcgtgctcggtggcgaagaagcctctcatcgccaactcggagaccttgagaggaaagccaccgcgcgctagggcctagggcagggcacgagcaaaggccctcccgcgggttccattggagcgcgagcgaacggcgccgacgcggcaacacacattcgctttatttgccatgacatcgccgtcctcgtcgtcgtcctggctgctgctgctcctctcgtgcctcgcgcttgccctgctcgcggcggacgccgaagtgcaccaccatgagttcgttgtccaagagacgccagtgaagaggctgtgcaagacgcacaacgtcatcacggtgaacgggcagtacccggggccgacgctggaggtcagggagggcgacacgctggtgatcaacgtcgtcaaccgggcgcagtacaacgtcaccatccactggcacggcatccggcagatgaggaccgggtgggcggacgggccggagttcgtgacgcagtgccccatcaggcccggcggcagctacaagtaccggttcaccatcgaggggcaggagggcacgctgtggtggcacgcgcacagctcctggctcagggcaaccgtctacggcgcgctcatcatccgccccagggagaacaagacctaccccttcgccaagccctcgcgcgaagtccccgtcatccttggggagtggtgggacgcgaacccgatcgacgtcatccgggaggcgcagaggacgggcggcgcccccaacgtctccgacgcgttcaccatcaacggccagcccggcgacctgtacaaatgctcccagaaagagactacggccatcccggtgaagcccggcgagacggcgcttctgcggttcatcaacgccgcgctcaaccacgagctgttcgtcaccatcgcgcagcacaggatgacggtgggtcgccaccgacgcgtcctacacaagcccttcacacctcggtgctcatgctcgc

SEQ ID NO: 1065 - DNA, 924 bp, Zea mays
gtgacactatagaacaagtttgtacaaaaaagcaggctggtaccggtccggaattcccgggatcttgagaggaaagccaccagcagcaagcgaagaccaccagcagcagcgcagcggcgacgtgtttcgctctcgccatggcgtcgtcgtcctcgtcccggctgctgctcctcctcctcccgtgcctcgcgctcacgctgctcggcgcggcagacgccgaagtgcaccaccacgagttcgttatccaagagacgccggtgaagaggctgtgcaagacgcacaacatcatcacggtgaacgggcagtacccggggccgacgctggaggtcagggagggtgacacgctcgtcatcaacgtcgtcaaccgggcgcagtacaacgccaccatccactggtacgtacgtcgttgaagctcgtttttctcaaccgtgagtgacatgacatgacatgacatcgatcgtctggtctgtctatactctctcccgttcatggccggctgtctcgatcaatgcgcgctgcatgcatggcgtgtgcaggcacggcatccgccagataaggactgggtgggcggacgggccggagttcgtgacgcagtgccccatcaggcccggcggcagctacaagtaccggttcaccatccaggggcaggagggcacgctgtggtggcacgcgcacagctcctggctcagggccaccgtctacggcgcgctcatcatccgccccagggagaacaagacctacccattcgccaagccctcgcgagaagtccccgtcatcctcggtgagtggtgggatgcgaacccgatcgacgtcatccgggaggcgcagaggaccggcggcggtcccaacgtctccgacgcgttcaccatcaacggccagcccggcgacctgtacaaatgctccaacaagagactacggccatcc

SEQ ID NO: 1066 - DNA, 1142 bp, Zea mays
tattttaggtgacactatagaacaagtttgtacaaaaaagcaggctggtaccggtccggaattcccaaactcggaaaccttgagaggaaagccaccagcagcaagcgaagaccaccagcagcagcgcagcggcgacgtgtttcgctctcgccatggcgtcgtcgtcctcgtcccggctgctgctcctcctcctcccgtgcctcgcgctcacgctgctcggcgcggcagacgccgaagtgcaccaccacgagttcgttatccaagagacgccggtgaagaggctgtgcaagacgcacaacatcatcacggtgaacgggcagtacccggggccgacgctggaggtcagggagggtgacacgctcgtcatcaacgtcgtcaaccgggcgcagtacaacgccaccatccactggcacggcatccgccagataaggactgggtgggcggacgggccggagttcgtgacgcagtgccccatcaggcccggcggcagctacaagtaccggttcaccatccaggggcaggagggcacgctgtggtggcacgcgcacagctcctggctcagggccaccgtctacggcgcgctcatcatccgccccagggagaacaagacctacccattcgccaagccctcgcgagaagtccccgtcatcctcggtgagtggtgggatgcgaacccgatcgacgtcatccgggaggcgcagaggaccggcggcggtcccaacgtctccgacgcgttcaccatcaacggccagcccggcgacctgtacaaatgctccaacaaagagactacggccatcccggtgaaggccggcgagacggcgctgctgcggttcatcaacgccgcgctcaaccacgagctgttcgtcaccatcgcgcagcacaagatgacggtcgtcgccaccgacgcgtcctacaccaagcccttcaccacctcggtgctcatggtcgcgccgggccagaccaccgacgtcctcgtcaccatggaccaggcgcccgcccggtactacgtcgccgcgcgcgcctacgtctccgggcagaacgtggcgttcgacaacaccaccaccacggcggtcgtcgagtacgactgcggctgcgcctccgacttcggccccaagatacagccggcgttccccgcggcgctc

SEQ ID NO: 1067 - DNA, 381 bp, Zea mays
atggctgagggaagaggcagtgcaagggccatcggcgccatggcgttcgccgttgcctgctgctactgctgcgtcgccatcgccgacgcagccaccacctactacgtcggggacagcaacggctggtccttcagcagccccagctggcccaacggcaagcacttccgcgccggagacactctcgtgttcaggtacatcccctggatccacaacgtggtggccgtggacgaggacgggtacaacggctgcacgacgccgccggggtcgcggacctacacgtccggcgccgacagcgtgacgctcgccaggggggacaacttcttcatctgcacccggttcggccactgcaacctcggcatgaagctcgtcgtctatgccgcg

SEQ ID NO: 1068 - DNA, 1046 bp, Zea mays
acctttgttgtggcagtgtgctgagttcaagttgcactggaacatctctggtttctactactgcaaagttgaatggagtcggtgactcccgattaactccacttggtccttcagtctcatagatctttttatgtaactcatcattttcttggcgaatcaggttgatcttattgtacaagtctgtattttcttggtgaaataaacttgcctttcgattcaaatcgtgaatctcatctatcaagagatggtccttctttgcgcggacaccacgcaggcttgtttccaattgattctccagggactgcagttctttgacattcagcccagaaagatcatctcccgtcaactgccgataattttcttgcaagttgtgcagttgttgtctcaagcttgctgcctccctttgccaaaacttaagctccgagttgggatttgcgacgacttgctgaagtactgcgatcgcgttaacgctttatcacgataccttctaccacatatcactaacaacatcaacactcatcactctcgacgacatccactcgatcactactctcacacgaccgattaactcctcatccacgcggccgcctgcaggagccagcaagtcgtcgcaaatcccaactcggagcttaagttttggcaaagggaggcagcaagcttgagacaacaactgcacaacttgcaagaaaattatcggcagttgacgggagatgatctttctgggctgaatgtcaaagaactgcagtccctggagaatcaattggaaacaagcctgcgtggtgtccgcgcaaagaaggaccatctcttgatagatgagattcacgatttgaatcgaaaggcaagtttatttcaccaagaaaatacagacttgtacaataagatcaacctgattcgccaagaaaatgatgagttacataaaaagatctatgagactgaaggaccaagtggagttaatcgggagtcaccgactccattcaactttgcagtagtagaaaccagagatgttccagtgcaacttgaactcagcacactgccacaacaaatag

SEQ ID NO: 1069 - DNA, 723 bp, Zea mays
atggggaggggaaagatcgtgatccgcaggatcgataactccacgagccggcaggtgaccttctccaagcgccggaacgggatcttcaagaaggccaaggagctcgccatcctctgcgatgcggaggtcggcctcgtcatcttctccagcaccggccgcctctacgagtactctagcaccagcatgaaatcagttatagatcggtacggcaaggccaaggaagagcagcaagtcgtcgcaaatcccaactcggagcttaagttttggcaaagggaggcagcaagcttgagacaacaactgcacaacttgcaagaaaattatcggcagttgacgggagatgatctttctgggctgaatgtcaaagaactgcagtccctggagaatcaattggaaacaagcctgcgtggtgtccgcgcaaagaaggaccatctcttgatagatgagattcacgatttgaatcgaaaggcaagtttatttcaccaagaaaatacagacttgtacaataagatcaacctgattcgccaagaaaatgatgagttacataaaaagatctatgagactgaaggaccaagtggagttaatcgggagtcaccgactccattcaactttgcagtagtagaaaccagagatgttccagtgcaacttgaactcagcacactgccacaacaaaataacattgagccatctactgctcctaagctaggattgcaattaattccatga

SEQ ID NO: 1070 - DNA, 1940 bp, Zea mays
  misc_feature (248)..(248): n is a, c, g, or t
aatccttactatattaggcataaaattaggtgtagtttatttatttactggtactacttctttagtcataattaggtgtactagcagctacgccctgacggagacaagcacacacaatagaaaagagcgccctcgtgctcagagtgctcgcctttagtttcgtggctactatatactagttgcgacgatttttattttctttctcttctgggctatcattagcacggccatttaggggtaatgagcancggccaataaactagtccccccccccccccgccctgagatgcatggggtagccaatcgggtgtcgccgtgcgcgcgcgcgcgcgtctggcctcctccttccctttccttgctaaataaagcaagtagcagataggggaaagtctgctcgcaagttgcatccgccctgcgccaagaaaagccatcgttcttcccacaaacgcacacatagaagcatcattcccctctcggctagcttcctcctctctccctcctcttcgtcttcctctttccttctcccttgggaaacctgctgcctttgagctttcttcttcgagtgctcccaccagatctcctcctccttaccttctttggcacgttcggcggcgcgcgcggagatagatagatcccgccatcgtcgtcgccgtccttgcttccgatcggagggccacaaccacaacctctcgctccttagcgtgcgcgcgcgagccagggtcaagaagagagctagctataggccggagatcgatggggaggggaaagatcgtgatccgcaggatcgataactccacgagccggcaggtgaccttctccaagcgccggaacgggatcttcaagaaggccaaggagctcgccatcctctgcgatgcggaggtcggcctcgtcatcttctccagcaccggccgcctctacgagtactctagcaccagcatgaaatcagttatagatcggtacggcaaggccaaggaagagcagcaagtcgtcgcaaatcccaactcggagcttaagttttggcaaagggaggcagcaagcttgagacaacaactgcacaacttgcaagaaaattatcggcagttgacgggagatgatctttctgggctgaatgtcaaagaactgcagtccctggagaatcaattggaaacaagcctgcgtggtgtccgcgcaaagaaggaccatctcttgatagatgagattcacgatttgaatcgaaaggcaagtttatttcaccaagaaaatacagacttgtacaataagatcaacctgattcgccaagaaaatgatgagttacataaaaagatctatgagactgaaggaccaagtggagttaatcgggagtcaccgactccattcaactttgcagtagtagaaaccagagatgttccagtgcaacttgaactcagcacactgccacaacaaaataacattgagccatctactgctcctaagctaggattgcaattaattccatgaagaagagtaaaactgccgtcttatgatgctgaaggaaactatttattgtgaagagatgatactcagagaaagacatatttgtggcagggagatttgagatatgaacttataaatgtaatgcaaataattttcagactggaatggggtcgtggaattcagaggatgattgctttctagttgcatttgatgtttgatgagacttttctcatgtgaaacgtttattaaaacttcaaaatggtgcagatgttgctactacacttgttaggcttgtataaatatttgaccttgtgtactagcattacgaaaacagaaaagaagacagacagccgtgataggggacaatgatgcgatctaggagtacaaacagagtctagtttccactcagttgagttttatattgctctcaagcgttatcaagggtttagtaggatacagatataattaagatacagtggttaaatcgc

SEQ ID NO: 1071 - DNA, 2420 bp, Zea mays
gaattcccgggtcgacccacgcgtccgcccacgcgtccggtcgtcctcttctctcgcctccaataattcgtaaccattctccttccaggccgggctcctgctggccggagttcccatctccctctttccttctcggttactatccgtgagtgtgcctgcccccgtgtgtgcgcgtgcaagatcgaccgggcgcagcttcacgatggggcgcggcaagatagtgatccgccggatcgacaactccacgagccggcaggtgacgttctccaagcggcggaacgggatcttcaagaaggcaagggagctcgccatactctgcgacgcagaggtcgggttggtcatcttctccagcaccggtcgtctctatgaatacgccagcacaagcataaagtcagtgattgatcgatatggtcgagcaaaggaggaggagcatgtagcagaccccaacacagagcttaagttctggcaaagggaggcagcaagcttgagacaacaactgcacaacttgcaagaaaatcatcggtacgtcaacaaaaccctgcaagttttacagatgcatcattcagaaaattgccaaatgtaaggaagatcaataaaagaattgtcagcatgagcacaaatacaaaacgtctgagtacagaaacacaagggattttttaaacaagaaaatccattctgctttttaaagaaacatatataaagtggtttaaaacaacaacaaatctgcgctgctggatcaaccttaaggagtaaggaccacgaggtaactagaacacctccaacatcgaacttgtgcagtgtatgaattagtatagcaatatgtgagaataattttagcatacaaaatgcataacaacagaacctagtttagggacgtggtaatgatgccataggataatacatggtttatgcagacatcagttttcacaagcaagagaaatgtaaaaggatgcaaaggcttgtgaacttcatgtgccaaaccatttatcaatagaaaactgtacatttagttatcttatgcattattattaacgtccaaagaagcagatacacaacattattgtaattttgtatgattaacccaaagcagcagatacacaccatcatatttaaatgtatttatttttttgcctactagtttttgagcgctctgatttgtaatcactctattccaagtaacagtactaaaggcatctgcagtgtaggaaatgaaggtgtcataagaccttaaagccgataaggtcagaaagcggtatttaacccaaaaaacttagaaccagaccattagcttaatacctggcctcagcaaattaaaaaaaacacaagcgaaggcaagaaactcctctcccacaggtgtgtggcagacaatggcaactgtggcctcccacaggaggacgcagctgcctcacgctgcagggagtggaaagggcctctagggcctcctgcagctagcggcgaggacctcgcatggaggaaggaggaggcgctgtgagcaggacacttggcgacggggaagacaaagcagcagagaggaagaggcctcattgagctcactttacggccattgggagtgccaggtgccctaacgcatacatagccagaagccgaatccttaaaaaggaacacgatatgatcaagcaacaagacccttttacattaaaatacagtcaaactcgaattgtaaaaactaagtgagattgtttgactggctgtaggcagttgatgggacaaaatctttctggactaggtgtcaagggacttcaaaatctagaaaatcagctagagatgagcatttgttgcatccggacaaaaaaggaccaactcttggttgacgaaattcacgaactgaatcgaaagggaagtctcatccaacaagacaacatgggattacacagaaaggtcaacctaattcgtcaagaaaatgccgaattatataagaagctctatgagaaagaagcagaaggtgaagtcaaccgagattcaacaactccgtacaactttgtagttgcagagggtgccaacgttcctatccatcttgagcttaatattccactgcaagaaaatggtgttgagcaacctgtggctcctaaattagggttgcaattaaatcaatgaagacatgcaggacattgcctttgttctcattgtccttgaagtctgcaactcaaagcagcctaaaatgataggttgtaacaggcctaaaaacattgcaagacaaataaagtatgcatgccagagacagtggcaatggtagtgcaaatctatctcaaataacttgtgttatattgaataatccagcaaatggtttgttttttacacgttatgcaagtttgtttgaccaaaatggtatgtaacatgtacaaatttccaagtgaacttattgaaaaaattctataaaaaaaaaaaaaaagggcggccgc

SEQ ID NO: 1072 - DNA, 950 bp, Zea mays
ccaagttatagatcttctcgcgccgccgctcgcagccgctcgccgcccggaacatctcccccgcgcctctccctgctcctggatttcaccgatctggcatgttttactgtcccgtcataggggggcagcgggagccgcccctttcctgcctccacagctcatgccatgcatggcagatccattccctcaaatcgggattgccgcatacatgccgttgcttccccgttagcttctcccttgttacaccccctcgcttcgttctgcgtattttcggggtttgacaccgcttgtctatccccttccgtccgcttttacgtgggcgagctcaaactccgcgccggcgtctcagttgctgcaagtggcggcagcaagctagaggcagcaactgcataccttgcaagaaaaaatcggttttgttgacgtaccgatgattttcttgcaagttgtgcagttgttgtctcaagcttgctgcctccctttgccagaactattgaatgtgaaagcacagatttagctaaaggctataataatcttcaaaggttcaatataaattcttggactatagactgaagtatggctgctgatcttccaagatctctccagttcagaggatgggattatgggagcttagaccagagctgtctaagcaattccagagtacagaagggtatactctgatcctagaaaagatggcatattctatcggaccagagtcaccagaccttggatgaaagggcttcagtttaagtcctacaagagatgaacgatggcaaccaccaaaagtccaactacgtagaacgatggcaaccaccaaaaattgcccattgttcatccgacgggcaatttgccgtttcttctcatggtgagacatgggatgctgcaacatgacccgaaaactggatttcaattcaagtgaacagtttctccatttgtacggtattccattgcaa

SEQ ID NO: 1073 - DNA, 729 bp, Zea mays
gcaccaggcaaagcgaggcagaaagcttgaggcagcaactgcataacttaaaagagcaccatcggcagttgttgggtcagcagctttctggcctgaacgtgggagatttgcagaatttagagaataagctggagacgagcctaagaaatattcgtctgaaaaaggaccaacttattttttatcagattcaagaattaaacaggaagggaagcctcatgcaccaggaaagcatggaactatacaacaaagttaaccttcttcatcaacataacactgaattacggagaaaggtgtatggacaaggagtaaataatgagcaaacaagtactactgttagacacagtactcggaatacagagaatcttccgatcaatcttgagctaagtgtgcaaagggacaaatcagaaacaccaagtgtagggtgagatttttgtccaaacttcaggataactcagagtcagtaaaccagatgatttaataaagaacactgaaagtgccataagactttaaatacagtgaggataactaaaccgagtgataagaaatggatatcgttggttgaattgcaagacctaacagctaaactttaagctgctagatgcgattgtttatgtattaagaagaatgttgattttaattttgcttttcatataagcttgccatgtatgctattgtaaattgtactctgaattataagtcctcttggttttctaggtaaaaaaaaaaaaa

SEQ ID NO: 1074 - DNA, 405 bp, Zea mays
  misc_feature (213)..(213): n is a, c, g, or t
  misc_feature (277)..(277): n is a, c, g, or t
atgctctggcaaagcgaggcagaaagcttgaggcagcaactgcataacttagaagagcaccatcggcagttgttgggtcagcagctttctggcctgaacgtgggagatttgcagaatttagagaataagctggagacgagcctaagaaatattcgtctgaaaaagattcaagaattaaacaggaagggaagcctcatgcaccaggaaagcatngaactatacaacaaagttaaccttcttcatcaacataacactgaattacggagaaaggtgtatngacaaggagtaaataatgagcaaacaagtactactgttagacacagtactcggaatacagagaatcttccgatcaatcctgagctaagtgtgcaaagggacaaatcagaaacaccaagtgtagggtga

SEQ ID NO: 1075 - DNA, 513 bp, Zea mays
atgccactgaacctctccccaccaagccaatccctgaacatcggtggaagatgggagaaaaagaaaagaaaacacacgccactgctttggcaaagggaggcaggaagcttgaggcagcaactgcataacttgcaagagcaccatcggaagttgttgggtcagcagctctctggcctggacgtgagagatttgcagaatttagagaatcagctggagacaagcctaagaaatattcgtctaaagatggaccaacttattttttatcagattcaagaattaaacaggaagggatacctcatgcaccaggaaaacatagaactacacaacaaagtcaaccttcttcatcaagagaacattaaattacgtagaaaggcgtatggacaaggagtaaatgagcatccaacaagtactacagttagacacagtattctgaatacagagaatgaagatgttcggatcaatcttgagctgagtgtgcaaggggacaaatcagaaacaccaagtatagggtga

SEQ ID NO: 1076 - DNA, 2510 bp, Zea mays
atggcagagggtgttgttggcatccttattctgaagcttggttcagccttgtttttagaggcttgcaggcttggcacaaaacagctctaccatgaagcttcagcccttggcaggctctttggtgagatccgtgatatcaaggaggaattggagagcatgcaatcttttctacaaggagctgagagattcaaagatactgacaacaacactgccaactttatcaagaagattcgtggccttgctttcgacattgaagatgttatcgatgagtttatctacaagatggaggacaagcatggcagttttgctacaaagatgaatcgtcggattaatcgtatttggacatggcgacgtctcacgtccaaattgcaaaagatcaaactgaaactagagaatgttgataagagaaatgttcgatatgacatgagaggaattgctagagaagatggaagcagtgatgctcatcatagatctaccgaccagatttcttacttccccaaagaggaaaatcttgtgggcattgatgaaaacaaggagttattgatgaattggctaaggggtgatctacatcagcaaagtgtaattacaacagtatgggggatggggggagttggcaagaccactttggttgcacatgtttacaacactgtgaaggtagactttgacagtgctgcatggataactgtttcaaaagcttaccaagtggaggacttgctgaagcagatcatcaggggatttcagaaaagtgatttgaaggatgacgtctggggtgttgacatctggttcaagataagagatgcttttcctaccaatagcactagcagaagcccaacctactctgattgggaaagctttttcaaggaactagagttgcagatgacaaataatgtgattcttaatgttaatgttcttctaaagggtgcccagattgtggagctgccagatgaggttttcaacttgtttaatctacggtttctcagccttcgaaatactgaggttacgaatatccccagcacagttggaagattacaaaaacttgaagtcttggatgtttataatgctaaactgttggctttgccagagagtgtttcgaagcttagaaaattgagatatctacatgtagctactgttccaaagataaatactaaaggggttgtgacctggattggaatccaggtgcctaaaagcatcaaatacctgacaggcttgcaaaccttgaggcttgttgaggcgagctcagagactttatttcaccttggtgctttgacacagttgagaacttttgccatcacaaatgtgcagagggatcagtgtgccgatttgtgcactgttataatgagcatgaagcatcttgttagcttagcaattatggctataagtgaggaggaaatacttcaacttgaagaactttgtttacccccaactctttcaaagcttgaattaggagggcagctggacaagaaagcaatgccccagattgtatcatccttttcagatcttggtaacctcaccttattggccttggcattctccaaacttgatgaggactcattttcatgcctcttgacgttgcatggtctacgtgggctttgggttgataaggcttatgaagggaagaggcttcactttaatgctatgtcttttccaaatcttcgacagcttgcaatatcagatgcaccgcagctcaacagcgttgtaatcgaacgaagcgcactgcaaagccttgttcagctgacacttgtagattgtccagaactgaaggccctgcctgatggcattgagcatcttagaacacttgagaaattatatctgcgaggagcatccaaagagctcacaaagctatttcagtgcaatgaagaaacacatgagtccaatgggaatcttgagaagatcggtcatatccgaagggttactgtttatccataagggtttgattggaagtaagggtaatggggaggattgaaggggctagaatctctcactattctattttaaatagtgaggaattctagccccctcgatctccttcgttccatttactcccaaactagccctaaaaaggatgcgaagacttggtgtcataaacccatacacttgcgtacaagtgttggccttgttaccgattgcatactactggccaactggtgtaatagctcaggacagtcaagagtaaaataaagttggtgaaaatatagttgggtctgaaccgctgaagtgagtggagactaataatttgtttttgtttccggtacttgattttactgttttgaccttatttttgtgtcactaatactcatcatgtatttgtagtcatacaggtatagattaaacgaaactcttcatcacacgcgaactgagcaaaagttgagcggtagataaattgtatatttttaaggctagttgggaactctatttttccaatggatttgtattatatttctgtatttgatctataaatatttcatgatattattttttaatacgtaatgcagaaaagtattaatcttttt

SEQ ID NO: 1077 - DNA, 1746 bp, Zea mays
  misc_feature (1556)..(1556): n is a, c, g, or t
atggaggcgacggcgctgagcttgggcaaggctgtgctgggcggagcgctcagctatgccaagtccaaggccgcagaggaggtcgcactgcagctcggcgtcgaggacgacgtgaccttcatcacggacgagctgcagatgatgcagtccttcctgatgacagccgatgaggagcgaagccagaccaaggtggtcacgacctgggtgacgcaggtccgcgacctggcctacaacgtggaggacagtctcatggatttcggcatcgacgttgggaagaagccgatttgggggtgcatcccccgtagctcgtgcgatcgacgtcgcatagccaaggaggtgaagaagctaaggtccaaggtcgaggatgtgagcaacaggaacctgcgctaccgcctcatcaaggatggctcaagatccaagcctgccggtgcggcggagcaaactactgcctctgatggtgtagagcgtcaaaaaccaaaggcagacctgctgcagctggtcactagcaaggaggtcgacctgagggtcgtggctgtgtgtggaacaaccggtgatcgtgggaagacggccgccatccatgaggtctatgatcacccaagtgtggcatcaaagtatggactcagggcatgggttaggctgatccaccctttcaatccagaagagtttcttcgtagcatggtacggcaattcttggagaatttccatgataagcctcaaggtggagaagaagcaacaaatgttggggctactgtccttctgaagatggacaagatgaaccaaagtgatttagtgcacacgtttactacacagttgagtagcaatagctatctaattgtaatagatgacctatgcacagtagaagagtggcaacgcatcagaaggttcttccctgacaacaagaaagagagcagaatcatagtgtccactcagcaagttgaggttgcaggcttatgtacagagcaaccataccaaatgtccgagtttaagcagctcccgtatgaccaaacactttatctgttccataggaaggttattagtgagatacaggaagaatatcaaccaccaaagagtacaggaaatagtttctctacctcaactactggcaaaaagtttgatcgcatgaggacaatgacactgaatgatgatgtacttgttgggagaaagactgagaaatctgaagttattgatttgattggtcaaccttcggacaagctctgtaaggtgatctctgtgtggggaatgggaggacttgggaaaactactcttgtccgaagcatctacagaagccaacagcttgatgactggaactggaagcgcgcttgggtcactgctacgcgtcctttcgacaatgaagtgctcatcagaaccctagcttcgcaactactccacgattctaatacagcaaatatgaagttggatgtcttaagaaaaaagatagaccagcttctactgaacgagaactatctcattgttcttgatgacctatcatctattgaagaatggaacttggttcgagaccaatgggcaaaggctaaacgcatcatagtcaccacaanagaatatagtgttgccaaatattgttcgggaggagacatgaacacgcacaaacttcaagtcctacaagaagaggatgcacttgccctcttcctaaagaaggcactaaggctgcccgcagtggaggactgggtgctggactctatcccatatagcgtaaagaaacacctgcagcgggtgactgggtgctag

SEQ ID NO: 1078 - DNA, 1259 bp, Zea mays
tcgacgaaatgcgacgccgagatcactgggctacgagtacggctgcgcgccggcacagccaagcgcggcagcggcgcttgcgtcgaagggaaatggttcgccggattcatcgccccattccgctctgggctaaggttccaccagcacaaccctatggcagaagcagtgctccttgctgtcactaagattggttccgttcttggagatgaacctgccaagaccattataaacaagctgtctgaaaaaattcaagctctgagggaactcccacggaaagtggatcacataaggatgaaactaataataatgagcaaagttatacagcagattggcacagtctaccttacagatgaacttgtgaagagttggattggggaggtccggaaggtggcttaccgtgttgaggatgtagtagacaaatactcataccatcttcttcaactggaggaagaagggtttctgaagaaatttttcgtcaagggtacccattatgccattgttttcagtgaaattgctgatgaggtagctgagatagaagaggagattcagcaagttattcagatgaaggatcagtggttgcagccatcccagcttgtccctcaccctgagcaactcgctgaaatcgaaagacagcgttcccaagacagtttcccagaatttgtcaaagatgaagatctagtaggaattgaagaaaatagaaaattgctgactggatggatttactcagaagagcaggctagcatggtgataacagtttctggtatgggtggactgggaaaatctacactggttacaaacatttatgaacgtgaaaaggtcaacttcccggtacatgcttggattgttgtgtcacaggtctacacagtcgagtctttgttgagaaagctactatggaagattgggcatatgcaaccaccagtgccaagagagattgacaaaatggatgtacatgacttgaaggaggaaataaagagaaagctccagaatagaaaatgcttgattgtgttggatgatgtttgggagcaagaagtatacttcaaaatacatgatgctttccagacactccatggaagccgcatcatcattacaacacgaaaggaccatgttggtgctattgcttcctttgaccaccatcttgagctccaaccgttgtgtgggcctgatgcatttgaacttttctgtagaagggcttttcacaacaagaaggaccacaaatgccccgaggagcttaaggaaattgctggtgaaatagtgaaaag

SEQ ID NO: 1079 - DNA, 1547 bp, Zea mays
ctcatgttcgccccctcctctgcgccgtcgccgccgtctccttccccatctccgcctccgtctccatccccatcccgcctcgtgccgcagcttctggtcgccctcctccagcgccgccgcttcgacgtcacgctccgggtctccccgaccttccccggcttctccccgcactcaatcgccgccgcgctcgccgccatcccgcgcttccttctcccgggctccccgcgccgcctctgcccgcaacggccgttcccctccgcctcgcacccttccaaccgtcgcctcgccgctgctctcactctcgccttcctctcctggtcgcacgcccacgcccacccccaccccgtcccgctctccgaagccccgctccgcgccgcggcgctcgcgctgacccgcgcccacgcgctctcgccgctcttccgcctcctccgtgcgcacgcttcggtcgtctccactgctgcgctcaccgacgtaatccgcgtgctcggtgaggaagggctcccgcgccacgcgctcgccgcgttccaccgcatgcgccagctccactgcgcccctgacgcgcagtgctacaacactttgatcgctgcgctgtgccggaacgggcggtttagtgatgcccggttcctgctcgaccagatggagcgacccggtgcgcgctgcaagccggacacctacacgtacacggtgctcatttcctggtactgccgcatcggggtgggcacgggatgccggaaggcggcacggcggaggatctacgaggcggggaggctgttcaggaggatgggagaaaaggggctcgagccggatgtcgtgacttacaactgcttgatcaatggcctgtgtaaaacgtaccgcgtggagcgcgcccacgagatgttcgatgaaatgctgaggaaggggtgcacgcccaaccgggtgacttactattcgttcatcagatactacagtgtggtgaaccaggtggacaaggctgttgaatggatgagggaaatggttgcgaggggccatgggatggccttgtcgagcacatacacgcctgtcatccattctttgtgtgagagccggcgtgttaccgaggcgaggcaattcttgattgatatggctgaaagtggacatgtgcctagggaacatacatacaagctggtgaaggctgcaatcgacgatgctggtgaggatgccttgccagcagggctatgtcaatcaattgaggatggcattacagcaaggtttcgacaggtgatgcaaattaaacccataatgcgaccagtcacaagatgatctgaaacaaacgagcttatggataaccataatctgtttgcatgagagatgctggtcttgcaagagaagtgttcttggttgagatacctaggatggtagtggtgcatggctacaagctaatatatgtgtaaactagtgccaactgagtgctcttgtaagaaaggagcaggcaatgagagcagggagaagttttggcatatgccattattcccaagataatttgaggctataataaagtttgtttgcacataaggtaaaatatttttaag

SEQ ID NO: 1080 - DNA, 1806 bp, Zea mays
ctcttcgccgcgaatgccgagacggcggaaaccgaccgcgcttccgtccgccaccgccgattgacaatgaagctcccggccgcactcccctggatctccccgctgcagtaccgaagacccggccgcggcgcgtcgccctccccaccgcctccaccccctcccacccggcggccgcggtacctccaccacccggaactcgcgcgcctcatcgagtcctccccctccgcgcagcgcgcgctcgacctcttcaacgcggcctcctcccagcacgccttctcccacacgccggccactttctcggcgctcctcgtccgcctcgcgcgcgcgcggctcccgcgcgccgccgccgccgtgctccgccgcaccgcctccgagccctgccggttccaggagccgcagttcctgcccctcgtccgcctcctgccgcccgaccacgcgctcgtgctcctccgcttcctgcccgcgctgctccgcacgagccgcgtctcacacaaggcgctggccgtctgcctcgaccgccttgtctcctcccgcggctgccacggcgtcctcaacgagctcctagccgatctgcgcgaccctcggaacaagtaccttccaaggcctaacacatgcgtctacaacattcttgtcaagcactacgtcaaaaacggcgaattggagaccgccttcaaagtgctcgacgaaatgcgcgagtacacctgcgcggacgtgaagccgaacctggtcacctattcaacattgatcggtggactctgccgtgggggtaagatgaaggaagcgtttgagctattcgaggagatgatcgagaaggaccgcattgtcccagatcagctgctgtacaatgtgatcatcgatgggttctgtagacaggggcaggtggataaggctcgtgcaatctttggatttatgaggaagaacgagtgtgagcccaacaccttcaattatgccacgctgattaatgggcactgtaagaaagcggacattgaggcagcgagatcggtgttcgaggagatgaggaattctggtgtggagccagatgctgtgagctacactgcactgatcggctgcctttgcagacatggaagtgtggatgagggcatcggtcttgttttggagatgaaggagaaggggtgtagggccgatgtcgtcacatacaatctggtgattgaggggttgtgcaaagatggccggactgtggaagcaatgggcctgctggagagcgtgccgctggaaggagtaaagttgaacgtcgcgagctaccggatcttgatgaactgcttgtgctcccgtggggagatggacagggcagttggcttgctgggattgatgcttggacgagggtttctacctcactatgcggcgtcaaacaacctgttgatcggtctatgcgatgctgggcgcatagcagatgctacgatggcattgtatgggttagctgatgcaggctttatgccagagcctagatgctgggagaggcttgtggagagtgttgaggtcttgaggaaaggaactggagatcgcggcagtgtatctttctgcccccatttgcactacagggctgaattgatgtttagcaacaacgaagagaaggctgctgggccctactggtactggagacagcaaccaacaggtcctgacacaaacttttcttccagaacaagctgctatatccagaaggtatcaaaccatgaaggcacaatggccgcattattcaccattctcgtcattggagacgtagtccaggatgaggtgccgcagttggctctggcaaacagacttccgctggggcctgtgtcagcttag

SEQ ID NO: 1081 - DNA, 438 bp, Zea mays
atgcgccagctccactgcgcccctgacgcgcagtgctacaacactttgatcgctgcgctgtgccggaacgggcggtttagtgatgcccggttcctgctcgaccagatggagcgacccggtgcgcgctgcaagccggacacctacacgtacacggtgctcatttcctggtactgccgcatcggggtgggcacgggatgccggaaggcggcacggcggaggatctacgaggcggggaggctgttcaggaggatgggagaaaaggggctcgagccggatgtcgtgacttacaactgcttgatcaatggcctgtgtaaaacgtaccgcgtggagcgcgcccacgagatgttcgatgaaatgctgaggaaggggtgcacgcccaaccggcagggctatgtcaatcaattgaggatggcattacagcaaggtttcgacaggtga

SEQ ID NO: 1082 - DNA, 2530 bp, Zea mays
gaagtgaagaagtgtgccctttggctatctgaggtggctttcctggggcacgtgattcctccccagggtattgcggttgaccccaagaatgttgcggctgtagtggagtggaagagaccttctagtgtctctgaaatcccaagtttcttggggcttgctggggattatcggcgtttcgtaccaaatttttccagcattgctaagcctttgactaagctcttggggaagggtgttcccttcgtctggtccggcgattgtgagatcagttatcagtcattgaagagcaagttggtggacgcccctatcctagctttgcctgagagcggtaagcgtttcacagtttatacggatgcttcgcgtattggtcttggctgtgtgctgatgcaggaaggcagggtgattgcttatggctcaaggcagttgaggaagcatgaggggaattatccaactcatgatctggaattggctgcggtggtttttgctctaaagtcgtggaggcattacctttatggcgaggcttgtgacattttcactgatcacaaaagcctcaagtatatttttactcagaaggagctgaatttgaggcagcgtcggtggctagaattgattaaagattatgaggtgtccattcattatcacccggggaaggctaatgtggtggcggatgcccttagcaggtccggggttccaaaggtggccgtgccgttgattgctgatctggaccgtttggggatcgctttgtgttatgtcggcaccgctagcgtggagactcagatgcttattcaatcccctcttatggagagagtgcgtgcggctcagcagcaggatcgtcttttgcaggaagcccgaaggagggttggtgatggtaaaccgcgagagttcaccattgatgagaatgatttggttcgtttcaggggccgtctttgtgtgcctcagaaatcagaggtgaagctggatatcctgcgagaagctcataaaacgccttacaccgtccatcctggcgaaaccaaaatgtaccgagatttgaagcaaaacttctggtggaagcggatgaaggttgacatttctaagtatgtggccgcctgtgaagtatgtcagcgcgtgaaggccgaacataagcggcctgcaggtttgctgaagccattggaaattccagagtggaaatgggagcatatcaccatggattttgtggtgggtctacctcgttcccctcgtggcagggatgctatttgggtggtagtggatcgcttgactaagtctgtgcattttattcccatgaagaccacgaattcagcttcagatttggttcccttgtatatgaaggaagtagtcaggcttcacggggtacctaagtctattgtttctgatcgagactccaaatttgtatccaaattctgggagagtctccacagtgcattgggcaccaagctttcgcttagtgtcgcttttcaccctcagacggatggtcagtcagagcgaacaatccaaaccttggaggatatgttgcgtgcttgtgttctgtcatggaagggtagctgggaggatcatcttgctctagcagagtttgcgtataacaacagctaccaagctagcatcaagatggcaccatttgaggctttgtatggcaggcggtgtatctctcctctgtgctgggagactttgggagagagatccctggttggtcctgattgggttcagcaaacttctgaaaaggttcgggaaattcgtcagaatattttggtagctcagagtcgtcagaagagttatgctgatgtgaggaggcgggatctggaatttgctgtgggtgaccaagtccttctcagggtatcacccactaagggagttgttcggttcggtgtctctgggaagctcagcccaagatacattggaccgttcactatcttggcccgagtgggcagcctggcttatcgcttgctgctgccggattctatggcaggggtacacccggtttttcatgtctctatgttgaggaagttcttgcgggatccggaccatcagattgagatggaaccaattgcggtgcagcaggatctgactctagagtgccgtccggtgcgtatattggaattctcggagcgtgtgttgaggaagagatcaattaagtatgtcaaggtcttatggtctaatcagtcagagcgcgaggctacgtgggaacttgaggagttgatgcggcagaagtacccggaacttttcgttgtgggtggtggacttccggatcgttcttagggattttgcccgaacttcggtaaaggcacctgatctttgctttgggaaggaagggatgtagcagcacggccaccacacttttaaataaaggaattactgattaataatgatgttaaacaggaagagtcaagtctagggaattattacattctaatctttcatggtagttgaactgtttagtttggtgggcggtgatgtctatcttttgtctggtcatgaatgttctttcctaccgttgtattttgattatactatgtcaattatctttcttttatattcaaaa

SEQ ID NO: 1083 - DNA, 4238 bp, Zea mays
atggcagggctgaggtgcctcttcccatcagtggtctttcactgatgtagtggatgggcatgaagttggacacttttgatggcagtggtactccggtcgaggcaacgaattggctaacttacgtggaggataatatgaatgtctttgagattgtgtatggtgattgtgttcgctttggcacacagctgctgaagggagaggctcaaaattggtggagaggcgtgcaggcagctcactcttcttcaccaagagtcctgtcctgggatgttttcatcaagcaatttgagaggaggttctacccggtcaccttcctggagaaaatgaagatttatttgcaatcctacaagcaagagaagaagtctgtcacagagtatgaagtgggcttcaacaagatggtccgctttgttcctcatgtggcttacaatgagatggagaaggtgagccagttctgttagggcctgaaaccttctatcaggcatgccttgggagcctttccgttggtggattttcatactacagtggagcaggcattgggtgtggagatgcaacaccagtacaccatggagtcacagaagtcttcgggtgttgatcagcctcgtggccaggacgcgaagaggggcaacacatgaggtctagcccacaacaggggcaagtctcagcaccagcgccaccacccctaccgtggcaaatcctttgaatcgggtacttcgggaggaagtactcagaggtatcgggctgttcctaagcccaggctagggctagtgtgtttccgttgtggtgatgcgcatcaccgtgcagagcctcacccgacggctcagtggggttcttctgttaacttcactctaggagcttcctcttctgcgggtatttctggagcttatgtgctacccgctgcggatggcagagagtaaggagacgtggtgacaggtacgatctcagttgtgtcgtttgtggcccatgctctttttgactctggtgctagctattcgtttgtttcggagaattttgtctcgcgagctggtctttcggtgcaaaggttgggtcacccaattttggttagttctgctaatggctccattagtagctgttcagtttgttaggggtgctccgtcattcttgctgatgaggtcttttcggccaatcttattgtgatttccttgagggcattcgatgttatcttgggtatagattggttatctcagtatcgcgcaattatatcctgtttttggaagacattgttattacaggcgccgtcgggtagggaggtggtattcttaggaagttccccaaagttcatgttatccttgttggcgcaattgcttttgcgggacatccgagtggtgtgtgactttgccgacgtgtttccagcagagcttccaggcattcctccggagcgcgatgcagcttttgaaatcaagctgattctgggtacgcagcctattcataaggccccatatcggatggctccaaaggagcaggttgaattgaagcggcaattggatgatctgctggctaagggtttcattaggcctagcaggtcgccatgggcttccccagtattgtttgttgagaagaaagataaaagcaagaggctatgtgtggattatcgtgctttgaatcaagtgacaatcaagaataaatatctgctaccccgtattgaggttctctttgaatagttgaggggtgcccaggtgttctctaaaattgatttgaactctagttatcatcaattgaggattcgtgaggaggataattagaagacagtcttttgcaccaggtatgggcattacgagttcgtagtcatgtcttttggcttaactaatgcccctgttgcttttatggaagcaatgaataggatgttacatgagttcttggatgactttgtggttgtgttcctggatgataccctgatctattcaaagaccaaggaagagcatgagcggcatctctgtctcgttctgagtgctcttaggaagaatcaattttatggcaaattgaagaagtacgccttttggctgtccgaagtggctttcctagggcatgtgattagtcagcagggcattgcggttgatcccaagaatgtcgcggctatggtggagtggaagagaccctctagtgtctctgaaatccgaagtttcttagggctcgctggatattatcgacgcttcgtaccaaatttttccagcattgctaagcctttgactagacttttggagaagggtgttctgttcgtctggtccagcgattgcgaggtcatttatcagacattgaagaacaagttggtgagcgcccctatcctagctttgcctgagagtggtaagcgtttcacagtttatacagatgtttctcgaattggccttggatgtgtgttgatgcaggaaggcagagtgatctcttatggctcaaggcagttgaggaagcatgaggaattatccaactcatgatcttgaattggccgcgatggtctttgctctaaaatcatggaggcattatctttatggcgagtcttgtgacatttataccgatcataaaagtctcaaatatattttcactcaaaaggagctgaatttgaggcagcgacggtggctcgaattgattaaggattatgatttgtccattcattatcacccagggaaggcaaatgtggtggctgatgcccttagcaggtccggggttccaaaagtggccttgcctttgatcactgatctggaccgtttggggatcgctttgtgctatgtcggcaccgctagtgaggagactcggatgtttattcaatcctccctcatggagagagtgcgtgtgactcagcagcaggatcgattattgcaggaagctcgaaagagggttggcgatggtaaaccccgtgagttcaccattgatgagaatgatttggttcatttcaggggccgtctttgtgtgcctcagaaatcagaggtgaagatggatatcttgagagaagttcataaaacgccttacaccgttcaccctggcgaaaccaaaatgtaccgagatttgaagcaaaacttctggtgcaagcggatgaaagttgacgtttctaagtatgtggccgcctgtgaagtatgttagcgcgtgaaggtcgagcataagcggccggcaagtttactgaagccattggaaattccggagtggaaatgggagcataccaccatggattttgtggtgggcttacctcgttctcctcggggcagggatgctatatgggtggtagtggatcgcttgactaagtctgcgcattttattcccatgaagaccaccaattcagcttcagaattggttcccttgtatatgaaggaagtagtcaggcttcacggggtacctaagtccattgtttctgatcgagactccaaatttgtatccaaattctgggagagtcttcacagtgcattgggtaccaagctttcgctcagtgtcacttttcaccctcagactgatggtcagtcggagcgaatgatccaaaccttggaagatatgttacgtgtttgtgttctatcatggaagggagctaggaggatcatcttgcattggtagaattttcttacaacaacatctaccaggctagcatcaagatggcaccatttgaggctttatatggcaggcggtgtatctcccctctgtgctgggagactttgggagagagatccctggttggtcctgattgggttcagcagacttctaagaaggttcgggaaattcgtcagaatattttggccgctcagagccgtcagaagagttatgctgatgtgaggagacgggatttggaatttgcagtgggtgaccaagtccttctcagggtattacctactaaaggagttgttcagttcggtgtctccagaaagcttagcccgagatacattggactgttcactatcttggcccgggtgggcaacttggcttatcgcttgcaattgccggattccatggcaggggtgcacccggtattccatgtctctatgttgaggaagtttttgtgggatccggaccatcaggtcgagatgaaaccaattgcggtgcagcaggatctgactctggagtgtcgtctggtgcatatcttggagtcctcgaagcgtgtgttgagaaggagatcaattaagtatgttaaggtcttatggactaatcagtctgagcgcgaggctacttgggaacttgaggagctgatgcggtagaaatatctcgaacttttctcgagatcgaattctttttaaggagggtagagtgtg

SEQ ID NO: 1084 - DNA, 837 bp, Zea mays
atggattttgtggtgggtctacttcgttcccctcggggcagggatgctatatgggtggtagtggatcgcttgactaagtctgtacattttattcccatgaagaccacaaattcagcttcagatttggttcccttgtatatgaaggaagtagtcaggcttcacggggtacctaagtccattgtttctgatcgagactccaaatttgtatccaaattctgggagagtcttcacagtgcattgggcaccaagctttcacttagtgtcgcttttcaccctcagactgatgatatgttgcgtgcttgtgttctgtcatggaagggtagctgggaggatcatcttgcattggcagagtttgcttataacaacagctaccaggctagtatcaagatggcaccatttgaggctttgtatggcaggcggtgtatctcccctctgtgctgggagactttgggagagagatccctggttggtcctgattgggttcagcagacttctgaaaaggttcggaaaattcgtcaaaatattttggcagctcagagccgtcagaagagttatgctgatgtgaggaggcaggatttggaatttgcagtgggtgaccaagtccttctcagggtatcacctactaaaggagttgttcggttcggtgtctctgtaaagctcagcccgagatacattggaccgttcactatcttggcccgagtgggcagcctggcttatcgcttgctattgccggattccatggcaggggtacacacggtttttcatgtctctatgttgaggaagttcttgcgggatccgaaccatcagattgagatggaaccaattgctgtgcagtag

SEQ ID NO: 1085 - DNA, 1140 bp, Zea mays
atgggcacatctgagcaaccatgcacgagcacgcccaactcgttcaccaccacctcctcctcctatgtcacctcccagcagattcatcatctgccacagcacgactccgtggtctgcaccgaaccggggctgggcttcccctactactatgtcactgaccgtcagcaggacgcagcgttcgacggcgacgaggtagagctcggcttccaggcttccaaggccaccagggtcgactactacagctcgccttaccagctgtcatggccgctggctcgcgccgcggccgccgagtcgtcgcgcgtcaggaagaagaggttctgggacgttctcgagagctgcaagcagaaggtcgaggccatggaggccatggagtcgccgctggtggcgttccaggaagccgaggacgggggcgccgtagtaggggatggcggcggcggcggcggcggccgagggagcgggggcggcgcggacgggatgcggctcgtgcagctgctggtcgcgtgcgccgaggccgtggcgtgccgcgaccgcgcgcaggccgcggcgctgctgcgggagctccaggccggcgcgcccgtgcacggcacggcgttccagcgcgtcgcgtcctgcttcgtgcagggcctggcggaccgcctggcgctggctcacccgccggcgctgggcccggccagcatggcgttctgcatcccgccgtcgtgcgcgggccgcgacggcggcgcgcgcgccgaggcgctcgcgctggcctacgacctgtgcccgtacctgcgcttcgcgcacttcgtggccaacgcctccatcctggaggccttcgagggggagaccaacgtccacgtgctggacctgggcatgacgctgggcctggaccgcgcccaccagtggcgcgccctcctcgacggcctcgccgcccgcgcgggcgccgccgccaggccggcgcgcgtgcgcgtcaccgccgtcggcgcccctgcggacgccatgagagccgtcggccgggagctcctggcgtacgcggaggggctcgggatgtgcctcgagttcagggcggtcgaccgcagcctcgagagcctgcacatcgacgacctcgggatcgccgctgacgaggccgtggccatcaacagcgtcctggagctgcactgcgtg

SEQ ID NO: 1086 - DNA, 2050 bp, Zea mays
atgcaggaaggcagggtgattgcttatggctcaaggcagttgaggaagcatgaggggaattatccaactcatgatctggaattggctgcggtggtttttgctctaaagtcgtggaggcattacctttatggcgaggcttgtgacattttcactgatcacaaaagtctcaagtatatttttactcagaaggagctgaatttgaggcagcgtcggtggctagaattgattaaagattatgatttgtccattcattatcacccggggaaggctaatgtggtggcggatgcccttagcaggtccggggttccaaaggtggccttgccgttgatcgctgatctggaccgtttggggatcgctttgtgttatgtcggcaccgctagcgaggagactcagatgcttattcaatcctctcttatggagagagtgcgtgcggctcagcagcaggatcgtcttttgcaggaagctcgaaagagggttggtgatggtaaaccgcgggagttcaccattgatgagaatgatttggttcgtttcaggggccgtctttgtgtgcctcagaaatcagaggtgaagctggatatcctgcgagaagctcataaaacgccttacaccgtccatcctggcgaaaccaaaatgtaccgagatttgaagcaaaacttctggtggaagcggatgaaggttgacatttctaagtatgtggccgcctgtgaagtatgtcagcgcgtgaaggccgagcataagcggcctgcaggtttgctgaagccattggaaattccagagtggaaatgggagcatatcaccatggattttgtggtgggtctacctcgttcccctcgtggcagggatgctatttgggtggtagtggatcgcttgactaagtctgcgcattttattcccatgaagaccacaaattcagcttcagatttggttcccttgtatatgaaggaagtagtcaggcttcacggggtacctaagtctattgtttctgatcgagactccaaatttgtatccaaattctgggagagtctccatagtgcattgggcaccaagctttcgcttagtgtcgcttttcaccctcagacggatggtcagtcagagcgaacaatccaaaccttggaagatatgttgcgtgcttgtgttctgtcatggaagggtagctgggaggatcatcttgcactggcagagtttgcgtataacaacagctaccaggctagcatcaagatggcaccatttgaggctttgtatggcaggcggtgtatctctcctctgtgctgggagactttgggagagagatccctggttggtcctgattgggttcagcaaacttctgaaaaggttcgggaaattcgtcagaatattttggcagctcagagtcgtcagaagagttatgctgatgtgaggaggcgggatctggaatttgctgtgggtgaccaagtccttctcagggtatcacccactaagggagttgttcggttcggtgtctctgggaagctcagcccaagatacattggaccgttcactatcttggcccgagtgggcagcctggcttatcgcttgctgctgccggattccatggcaggggtacacccggtttttcatgtctctatgttgaggaagttcttgcgggatccggaccatcagattgagatggaaccaattgcggtgcagcaggatctgactctggagtgtcgtccggtgcgtatattggaattctcggagcgtgtgttgaggaagagatcaattaagtatgtcaaggtcttatggactaatcagtctgagcgcgaggctacgtgggaacttgaggagttgatgcggcagaagtacccggaacttttcgttgtgggtggtggacttccggatcgttcttagggattttgcccaaacttccggtgaaggcacctaatttctgcttggggaatagagggatgtagcagcacggtcacttcacctttaattaaaggaacccccacttaataatgttgttaatcagagttggtcaagtccagtgaattactttgttcttggttgagcgtttgttttgggtgggctgagt

SEQ ID NO: 1087 - DNA, 3084 bp, Zea mays
atggctgaagccatcagcgcgaccagctcgtgcctggaacccctgtgcggttgtctggaaagcacaggcgtgttcgaggcagtgggccgggaggtggccgcgttccttcgcatcaagtcgaattgtggcgacctcgagaaggcccgggacagcctgcgcgccgtcgagacgacagtcagggcgcgggtcacggcggaggaggacaagctgaacgtctgtgatcctcaggtgcaggcgtggctcaagcgcgtcgacgagcttcgcctggacaccatcgacgaggattacagcagtctgtcggggttctcttgcctctgccagtgcaccgtgcacgctcgtcgccgcgcctcgatcggcaagcgtgttgtggacgcgctggaggaggtgaacaaactgaccgaggaaggaaggcggttcaggacatttgggttcaagccaccgccgagggccgtcagtcagttaccccaaactgagaccgttgggttggagcccatgttggctcgggtccatgatttgcttgagaagggcgagtcgagcataattggtgtgtggggtcaaggaggcatcggcaagacgactctcctgcacgccttcaacaatgatctcgaaatgaaagaccaccactaccaggttgttatttttattgaagtatccaattcagagacactgaacacagtggagatgcagcagactatctccgataggcttaatttgccatggaatgaatcagagacagttgagaaacgggccagattcctattgaaggcactggccaggaaaagatttctattgctacttgatgacgtaaggaagagattccgactggaggatgtcggtatcccaactccggacacgaagagccaaagcaagctgatcctgacatcacgtttccaagaagtatgcttccagatgggtgcacagaggagccgcattgaaatgaaggttttggatgataatgctgcctggaacctgttcttgagcaagctgagcaacgaggcttttgcagcagttgagtcaccgaatttcaacaaggttgttcgggaccaggccaggaaaatattctccagttgtggaggtctaccacttgcactcaatgtcattgggactgctgtggcagggttggaaggaccaagagaatggatttcagctgctaatgacatcaatatgttcagcaatgaagatgtggatgaaatgttttatcggctgaaatacagctatgacaggctgaaacccactcaacaacagtgctttttgtactgcactcttttcccagaatatggatctattagtaaggaaccattagttgattattggctggctgaaggtttgcttctcaatgatcgtcaaaagggtgatcagataattcagagccttatttcagcatgcttgttgcagaccggtagctcattgtcatcaaaagtaaaaatgcaccatgtaatcaggcatatggggatttggttggttaacaagacagatcaaaagtttctcgttcaagcagggatggctttggatagtgctccaccagcagaagagtggaaggaatcgacaaggatctccatcatgtctaatgatatcaaagagcttcctttctcaccggaatgtgaaaacctcactacgttgttgatccaaaataacccaaatttgaacaagctgagttcagggtttttcaagtttatgccctccttgaaagtgctggatctttctcacactgcaataacaacactcccagaatgtgagacattggttgcattacagcatctcaatttgtcacacacacgtattaggttattacctgagcggctgtggttattgaaagagttgaggcatctggatctcagcgtgactgctgaactcgaagataccttgaacaactgctcaaggttactcaatttaagagttcttaatctctttcgcagtcactatggtattagtgacgtcaacgacctgaatctggattccctgaaggcactgatgttccttggaatcactatttatacagagaaggtgttaaagaaactgaacaagactagtcctttggcaaagtcaacatatcgtctgcatcttaagtactgtagagaaatgcagtcgatcaaaatctccgatctcgaccacttggtgcaactcgaggagctgtatgtcgaatcatgctataatctaaacactcttgttgctgataccgagctgactgcatcagattcaggcctgcagctcctcaacctctcagttcttcctgtgctggagaacgtcattgttgcaccaacgccccaccattttcagcacatccgcaaattgaccatttcgagttgccccaagttgaagaacatcacatgggtcctaaaacttgaaatgctcgagaggctcgtcataacccattgtgatgggttgctgaagattgttgaagaagacagcggtgatgaggcagaaacaacaatgctgggtcagggtcatccttctgaagaacaggaagataaacggattgatggtggtcaaagtgtgtgcaagagcgatgacaatgcgcatgctgagctcctgaacctgagatcaatcgtgctgactgatgtcaagagcctgagaagtatctgcaagccaagaaattttaccagcctcgagaccatccgggtggaggattgcccgaatctgagaagcatcccactgagcagcacgtacaactgtgggaaactgaagcaggtgtgcggttcagttgaatggtgggagaaactggagtgggaggacaaggagggcaaggagagcaagttcttcattccaatctgacaggcccctccgttcagctgttctcggcggttgctgtgtcagttggcaggaagcttcgttcaatgctgccacgaataagcggttcggaatctgtatatgcgacgagttgtttcttttacaggtagtctgtgtatattgcttgtgttcacaaacctgtacatgatctgattcattcatgtattgctgtaaatgcgatcaataaaattccatttgtctacttggataaaaaaaaaaaaaaaaaaaaaaaaaaaaaagggcggccgctctagagtatccctcgaggggcccaagcttacgcgtacccgagctttc

SEQ ID NO: 1088 - DNA, 3855 bp, Zea mays
atggccgacttggcgctcgccggcttaaggtgggcagcatcgccgattgtcaacgagcttcttactaaagcttcagcttacctcagtgtggacatggtgcgtgagatccaacgactagaagccactgtcctgccacagttcgagctggtgattcaagcggcccagaagagcccccacaggggcatactggaggcatggctccggcgtctcaaagaagcctactatgatgccgaggacttgttggacgagcatgagtacaatgtccttgagggcaaggccaagagcggaaaaagtctcctgctgggagagcatggaagctcctccactgcaactactgtcatgaagccttttcatgctgctatgagcagggcacggaacttgctccctcaaaacagaaggctaattagcaagatgaacgagctcaaagcaatcctgacagaagcccaacaacttcgagatcttcttggtttgccacatggcaataccgtcgagtggccagctgcagcacctaccagtgttcccacaaccacatcacttcccacttccaaggtttttggtcgcgacagggatcgtgatcgtatagtagattttcttctcggcaagacaacaactgctgaggcaagctcagctaagtactcgggtttggccattgttggattgggaggaatggggaagtccaccttagcacagtatgtctataatgacaaaaggatagaagaatgctttgatatcaggatgtgggtgtgcatctcacgcaaacttgatgtgcatcgtcacacaagggagattatagagtctgcaaaaaagggagagtgcccacgtgttgataatctcgatactctccagtgcaaattacgtgatatactacaagagtcacagaaattcctgcttgtcttggatgatgtttggtttgaaaaatctcataatgagacagagtgggagttattccttgctccattagtctctaaacagtcagggagcaaagttttggtgacttctcgaagtaaaacacttcctgccgctatttgttgtgaacaagaacatgtcattcatttggaaaacatggatgatactgagtttttggctctttttaaacaccatgctttctctggagcagaaatcaaagaccaactgttacgcacgaagctggaagacactgcagaggagattgctaaaaggcttgggcaatgtcctttggcagcaaaagttctgggttcccgattgtgcaggaaaaaggatattgctgaatggaaagctgctctaaagcttggagatttaagtgatcccttcacatctctgttgtggagttacgagaagttagaaccacgtctgcagaggtgcttcttgtattgcagcttgtttccaaaaggtcatagatatgatcctaatcagttggttcacctctgggtggcagaaggatttgttggttcatgcaatttgagtaggagaacattggaagaggctgggatggattacttcaatgatatggtctctggatcattcttccaatggtacggtcggtactatgtcatgcatgatatccttcatgattttgcagagtcactctctagggaagactgctttagattaaaagatgataatgtgacagaaataccatgcactgttcggcatctatctgttcatgttcaaagtatgcaaaagcataagcaaattatctgcaagctatatcatttacgcactattatctgcatcgatccgctaatggatggcccaagtgatatttttgatggcatgctacggaaccaaagaaaactgcgtgtattgtctctgtcattttacaacagcaaaaatttgccagaatctattggtgagctgaagcacctccggtatttgaacctcatcaggacgttagtttctgaattgcctacatcattatgtactctctaccacttacaattactttggttaaaccacatggtggagaatttgcctgacaaactatgcaatttaagaaagctacgacatctaggagcgtactcatgttacgcttatgatttcgttgatgaaaagcctatttgccaaattctgaatataggtaagttaacgtcgctacaacacatttatgtcttttctgtacagaagaagcaaggttatgagctgcgacagttgaaggacttgaatgagcttggtggcagtttaaaagtgaaaaatcttgagaatgtcattggaaaggatgaagccgtagagtcgaagctatatctgaaaagtcgccttaaagagttggcatttgagtggagttccgagaatggcatggatgcaatggatattctagaaggtctgagaccgccaccccaactgagtaagctcacaatcaaaggttacagatctgatacatatcctgggtggttactagagcgatcctattttgagaatttggaaagttttgagcttagtaattgcagtttgctagaaggcctaccaccagatacagagctccttcggaattgctctaggttgcgtataaactttgttccaaatttgaaggaactatctaatcttccagcaggccttacagatttatcaattgattggtgcccactgcttatgtttatcaccaacaatgagctaggacagcatgacttgagggaaaatataataacgaaggcagacgacctggcatctaaacttgcattgatgtgggaggtggattcaggaaaagaagttaggagtgtgctgtcgaaagactattcatctcttaagcagttgatgacattgatgatagatgatgatatgtcaaagcatcttcaaattattgaaactggtctagaggaaggagataaagtatggatgaaagaaaacatcatcaaggcatggctcttttgccatgagcagaggataagattcacttatggaagggccatggagctgcaagtggttctaccattaggactttgtaaactttccctttcgtcatgcaatattatagatgaagctttagctatttgccttgaaggcctcacttcactggcaactttagaattggaatatgatatggcactaattacacttccatcagaagaggtgtttcaacatttgacaaagcttgacatgttggttgtaagtggttgtttgtgtctcaaatcactggggggcttacgtgctgctccatccctttcctctttttactgttgggagtgtccttctttagagctagcacgtggagcagaactaatgccgttgaaccttgctagagaactcaacatccttggctgcattcttgcagctgattcgttcattaatggcttgccacatctgaaacatctttccattgatgtctgcagaagctccccatccttatcgattggccacctgacctcccttgaatcattacgtctaaatggcctccctgatctttactttgttgaaggcttgtcttccctgcaccttaagcacctacgtttagtagatgttgcaaacctcactgccaagtgcatctcacagtttcgtgtccaggaatcgctcacggttagtagctctgtattgctcaaccacatgctaatggctgaagggtttacagccccaccaaatcttactcttccagcttgcaaggagccgtcagtttcatttgaagagcctgcaaatctctcatctgtcaagtgcctgaatttttcgttttgcgaaatggagtccctgccaagaaatcttaaatctctctcaagtctagagagtctttctatagggtattgccgcaacatagcatctttaccagatctgccgtcctccctccagcgcataagtatatcaggttgccccgtcttgaagaagaactgccaagaacctgatggggaaagctggccaaagatttcgcaccttcgctggaagcgcatcgactaa

SEQ ID NO: 1089 - DNA, 1922 bp, Zea mays
  misc_feature (224)..(224): n is a, c, g, or t
  misc_feature (227)..(229): n is a, c, g, or t
acaggattgcttgttaatctggcgcgcctcacatgtgttcgccggcttgctcatatgatcggcctctctctcttttgcaggtgttcatcacttgagctcatatcatcgtcagaggcaggcagcagtaagcagattccgctgttgctgagcattgtcgtcgtgggcgtggcaggccagttcgcgtggagacggggagggaacatctggtgtgcgtttgctaaccnggnnngctgctccggaaatgttcggtcgcggcagttcctgcgagctgtggccctccgcctcccgctgcgtcgttgaagcttctgctggattctgggggcggccggcgggtggaggcgaccaggcgaggactgctctgcggcggcaaagggtttcaaaatgctggcgtgcatcgcctgctcggccaaggacgggggggatcaggacggctcccgcgccgccacgccccacggaagggacgccggcaagtccctcacctcccagctcaaggacatggtgctcaagttctccggctccggcaggcagtacaaggccgcggcggcgagcccgtcgttccggggcaaccgcttccaccgcaacagccgcctggccgcgtacacgggcgtcattgacgactcgggcttcacgtcggacggggccaccgagggctacggctacatgaggacgacgacgcacgcgaccggcgccaccgcgggaaccaaggtcggccgtggcttcccgcagcacgtcaggagcccgagcgcgagctggataccgagcatcggggaggaggacgatgaggaggatgaagaggttgtcgtcgttgaagaggaccgcgtgccgcgggagtggacggcccaggtggagcccggcgtccagatcaccttcgtctccaccgccggcggcgctggcaacgacataaagcgaatccgcttcagccgcgacatgttcaacaagtgggaggcgcagcggtggtggggagagaactacgaccgcgtggtggagctctacaacgtgcagacgttcagccggcagcagggcgtctcgacgccgacgtcctccatcgacgatgccacgcagagagactcgtcgttctactcccgcgccggctcgacgagggacagcccggtgatcctgccgccgacagccgtgggcagggagcagccgatcgcccgcgccacctcgtgcagggccacggccgcggcggcttccacggcccgagccgcgtgcaacccatcgtccagtgcggtgccggacccgtcggaccacgtgtgggcgcaccacttcaacctgctcaactccgcgccggcgccggcaccggccgctccgcacctcgacccgtcgcgcgctaccacgtcgtccctggacgaggcgtccgtgtccgtgagcaacgcgagcgacctggaggccacggagtgggtggagcaggacgagcccggcgtgtccatcaccatccgcgagttcggcgatggcacccgcgagctccgccgcgtccgcttcagccgggagaggttcggcgaggagagggccaaggtgtggtgggaccagaacaggaaccgaatacacgcgcagtacctgtgacgtcggactcggagctagctgttgggtgtgcagtacacgcgttggatggaagccaagccaccaatccatggacaatagtagcgtagggctgagtcagtgatactattgcgactactgtctactagtgctagtttttacagggtgaacagaggtgaaagaggtccacggaatggagcctgtgtaaaacatgtttgctactactactgatctgggtttgtgtgttgatgaccaatgtattttttttcttgatgaactaatactgttttgtgttgatcgcctcaaaaaaacagtgctcacatttgcgcggccgctctagagtatccctcgaggggcccaagcttacgcgtaccccagctttc

SEQ ID NO: 1090 - DNA, 1319 bp, Zea mays
atggtgctcaagttctccggctccggcaggcagtacaaggccgcggcggcgagcccgtcgttccggggcaaccgcttccaccgcaacagccgcctggccgcgtacacgggcgtcattgacgactcgggcttcacgtcggacggggccaccgagggctacggctacatgaggacgacgacgcacgcgaccggcgccaccgcgggaaccaaggtcggccgtggcttcccgcagcacgtcaggagcccgagcgcgagctggataccgagcatcggggaggaggacgatgaggaggatgaagaggttgtcgtcgttgaagaggaccgcgtgccgcgggagtggacggcccaggtggagcccggcgtccagatcaccttcgtctccaccgccggcggcgctggcaacgacataaagcgaatccgcttcagccgcgacatgttcaacaagtgggaggcgcagcggtggtggggagagaactacgaccgcgtggtggagctctacaacgtgcagacgttcagccggcagcagggcgtctcgacgccgacgtcctccatcgacgatgccacgcagagagactcgtcgttctactcccgcgccggctcgacgagggacagcccggtgatcctgccgccgacagccgtgggcagggagcagccgatcgcccgcgccacctcgtgcagggccacggccgcggcggcttccacggcccgagccgcgtgcaacccatcgtccagtgcggtgccggacccgtcggaccacgtgtgggcgcaccacttcaacctgctcaactccgcgccggcgccggcaccggccgctccgcacctcgacccgtcgcgcgctaccacgtcgtccctggacgaggcgtccgtgtccgtgagcaacgcgagcgacctggaggccacggagtgggtggagcaggacgagcccggcgtgtccatcaccatccgcgagttcggcgatggcacccgcgagctccgccgcgtccgcttcagccgggagaggttcggcgaggagagggccaaggtgtggtgggaccagaacaggaaccgaatacacgcgcagtacctgtgacgtcggactcggagctagctgttgggtgtgcagtacacgcgttggatggaagccaagccaccaatccatggacaatagtagcgtagggctgagtcagtgatactattgcgactactgtctactagtgctagtttttacagggtgaacagaggtgaaagaggtccacggaatggagcctgtgtaaaacatgtttgctactactactgatctgggtttgtgtgttgatgaccaatgtattttttttcttgatg

SEQ ID NO: 1091 - DNA, 779 bp, Zea mays
ccgccccacctcgtgcagggccacgcccgcggcggcttccacggcccgagccgcgtgcaacccatcgtccagtgcggtgccggacccgtcggaccacgtgtgggcgcaccacttcaacctgctcaactccgcgccggcgccggcaccggccgctccgcacctcgacccgtcgcgcgttaccacgtcgtccctggacgaggcgtccgtgtccgtgagcaacgcgagcgacctggaggccacggagtgggtggagcaggacgaccccggcgtgtccttccccatccgcgagttcggcgatggcccccgcgagctccgccgcgtccgcttcacccgggagaggttcggcgaggagagggccaaggtgtggtgggcccagaccaggaaccgaatccacgcccagtccctgtgacgtcggactcggagctagctgttgggtgtgcagtccccgcgtgggatggaagccaaccccccaacccatggccaatagtagcgtagggctgagtcagtgatactattgcgactcctgtctactagtgctagtttttccagggtgaacagaggtgaaagaggtccccggaatggagcctgtgtaaaacatgtttgctactactactgatcggggtttgggtgtggatgaccaatgtattttttttcttgatgaactaatactgttttgtgttgatcgcctcaaaaaaaaaaaaaaaaaaaaaaaaaaaaaaaaaaaaaaaagggcggccgctctagagtatccctcgaggggcccggagcttacgcgtacc

SEQ ID NO: 1092 - DNA, 1691 bp, Zea mays
gctggttcctttttatcgacacaggattgcttgttaatctggcgcgcctcacatgtgtgcggcggcttgctcatatgatcggcctctctctcttttgcaggtgttcatcacttgagctcatatcatcgtcagaggcaggcagcagtaagcagattccgctgttgctgagcattgtcgtcgtgggcgtggcaggccagttcgcgtggagacggggagggaacatctggtgtgcgtttgctaaccggggggcggccggcgggtggaggcgaccaggcgaggactgctctgcggcggcaaagggtttcaaaatgctggcgtgcatcgccatgcaaaaataccatgtgccatgatcataaatttctgcaccttcgaccatctgacacaaggaagcatttccgcaaatgtgctttctagctcaaggacatggtgctcaagttctccggctccggcaggcagtacaaggccgcggcggcgagcccgtcgttccggggcaaccgcttccaccgcaacagccgcctggccgcgtacacgggcgtcattgacgactcgggcttcacgtcggacggggccaccgagggctacggctacatgaggacgacgacgcacgcgaccggcgccaccgcgggaaccaaggtcggccgtggcttcccgcagcacgtcaggagcccgagcgcgagctggataccgagcatcggggaggaggacgatgaggaggatgaagaggttgtcgtcgttgaagaggaccgcgtgccgcgggagtggacggcccaggtggagcccggcgtccagatcaccttcgtctccaccgccggcggcgctggcaacgacataaagcgaatccgcttcaggtgcttattatctatcgccaacagctagctttgcgcgcgactgctgcatcaagtgcgcgcgtgctcagctaacgtaacggagcatcaaacgtgtctggcgtgcagccgcgacatgttcaacaagggggaggcgcagcggtggtggggagagaactacgaccgcgtgggggagctctacaacgtgcagacgttcagccggcagcagggcgtctcgacgccgacgtcctccatcgacgatgccacgcaggtgcgtagccgtctcgaccaccggcgccggtgcagcgtatgccgcacgcacgtacgtttctgtgctgtcgtcgtggatcaggccacccaactgaaacggttgttggcatgcagagagactcgtcgttctactcccgcgccggctcgacgagggacagcccggtgatcctgccgccgacagccgtgggcagggagcagccgatcgcccgcgccacctcgtgcagggccacggccgcggcggcttccacggcccgagccgcgtgcaacccatcgtccagtgcggtgccggacccgtcggaccacgtgtgggcgcaccacttcaacctgctcaactccgcgccggcgccggcaccggccgctccgcacctcgacccgtcgcgcgctaccacgtcgtccctggacgaggcgtccgtgtccgtgagcaacgcgagcgacctggaggccacggagtgggtggagcaggacgagcccggcgtgtccatcaccatccgcgagttcggcgatggcacccgcgagctccgccgcgtccgcttcaggcaagtcaatgtccactaagctactcaaatctacctgtgcaagatcgagcagataatcatg

SEQ ID NO: 1093 - DNA, 913 bp, Zea mays
atggctaggcagaaatataatgaaactatttctgaatacattagaaggtttagagaaacaagaaacaaatgttatagcttaactttaggggaaaaggatctggccgatttagctttcgcagggttatcatcctatccgatggagaaactagaggagcaagattttactgacataaaccaagtcatgcagcgtgctatcacccatgaaagtcgtgctagggacaataaacagcatagccgatttagagatacgaatggcagggagaaagagaaacagggggttaacatgttagagcccaataatggcagcgatgaagagcacagatgtatgtgtggctgaatggatagatgcgccaaagggtaggcctatgacgtgtgcttttttaaagccaagtccagggaaaagggaagagatgaaatatacatttgatgtgtccaagtgtgataaattgtttgacatcttattgcagaataacatcattagattaagggaggggcatgttattccaccccctgagcaattggctaagaaagattattgtaaatggcataattcattttttcattctaccaacgagtgtaattattttcaccgtcagatacaatcggccctgactgatggacgattgacatttggagaagctaacaaaatgaagcttgataaagatccattccctatcaatgtaattgatttcgagagcaaaagagtgctagttcggacagatcaggccgaaactactaaaggcaagaatgtggttatctctgatgatctcaaactaaagatgataataccaaagagtccgaaagttggtgtgtggaaattgagagcacctagagccgattgcgtgaaagcgaagtctaggagtcttaagatgtttcttgtaagcttggtgttctcctccatgcgcctaggg

SEQ ID NO: 1094 - DNA, 1104 bp, Zea mays
gccaaggtgttaccattacaatgttatgacatgatattaggtgaagattggcttgaggaattgcttctgataaatcaggacaatgatttgcctacagaaggtcctgcctctcgagtatgtgagattcagaatattgagcaacatccaatacctctcagaattcagcagctcattgattcttttgctcacctcttcagttcacccacaggacttccaccacatcgcttagctgatcatcgaattcctctaatgcctggtgctcaaccggtgaaagtgagatcttaccgatactctcctgctcaaaaatctgaaatcgagaagcaattgaaggaaatgttgactcaagggataattcgtccgagcactagcccctttgcttctccggtaattttggtcaaaaagaaagatgggagttggcgattttgtgttgattatcgacacttaaatgcgatcacaatcaagaataaacatcccatgccaatagtggatgagctgctagatgagttggtcggagcttgttggtttactaaattggattttagcgctggataccatcaggtctgcatggctattggagaggagtacaagatagcattcagaactcataatggcatgtatgaattcatggttatgccttttggctttacaaatgctcccgcaacatttcaaggacttatggatcacatttttgctgatttattgaggcatggagtgatggtattcatggatgacattttgatttacagccacacattacatgagcatgagttgttgttgcaacaggtgtttcagactctgaatcaacacaagttcttgattaaaagaactaaatgcacttttgctcaaccatccatagaatacttaggccatgtgatttcagcccaaggagtatctattgaaccctccaaagtggctgcagtcaagaactggcctattcccaagaatgtgaagcaactccgaggttttttaggtctcacaggatattataggaagttcatcaaagactatggaattgttagtcgaccactaaccttattgcttaagaagggttcaatgttccggtggtctgagcaacagcaagtggattttcacatgcttaaatag

SEQ ID NO: 1095 - DNA, 1872 bp, Zea mays
atggaggacttcacgaagaagttggagggattggaaactatgttgcagaagaccttcgatgctgtgagcggcttggagtcgtggcgaactagtgcaaaccagtcgctcggcacattgcttcagagaacggatgaggcgggaacgcgtctgcagcaattggaatctccaccgatgcgacctctcccgccgccaccacctccgccgccccgccaaccagcttcatcgaagtattgcgatccgttcaacatgcatcaatttcgaccacaagcaggcggatcgagcacgctggacctaggtctggctccgtcaggattgttgcgcccccctgtgataggcatggagaacgctcacgggcaccatctgcagcaaactccccgagatgttggtggtgggattttaggatcccatccaccacccccggtcacgggtatgaatttgtcccatgatctcctagattttgatgcatctatgggttctcgagatcattcgactttaattctgaaaatggagtttcctaaattttatggaaataatccgcgactatggcgtgatcagtgtgaaatgtttttcgaggtttattcgatggcggagaacctgaagacccggttcgcggcgctcaactttattggtcctgcagcgacttggcgccagacgttggagcgtcgtgggcgtatcctgaattgggaagtgttgtgcagggaagtgtttcaacgttttgacaaggatcaatattcagtgcacttaagacagttggactctcttcggcaacagggttcggtgtcggattatgtgcacacatttgagcagttggcacatgggattttgttttacaatagcaactacgatgatacatattttgtcacacggttcttgggagtgctcaaagaggaaattcgtgcgctgattgcgttgcatcgtccgagagatgtagcaacaacaagtgtgttagcactgctacaagaagaggaacttaatctggtgaagactcgagcaatgactaaggagtacaatagaggccattatcgcacaggcaaggagaatgacaaaccaaaggatggcagtatggaggtgaacaaaattaaagttgaccgaacagagagaagtgacaagttagaagcattgcgaaattatagaaggaaaaatggattgtgtttcaagtgtggcgaaaaatggggtcaacagcataagtgccctacccagatcttgttacatgccaaggtgttaccattacaatgttatgacatgatattaggtgaagattggcttgaggaattgcttctgataaatcacgacaatgatttgcctacagaaggtcatgcctctcgagtctgcatggctattggagaggagtacaagatagcattcagaactcataatggcatgtatgaattcatggttatgccttttggctttacaaatgctcccgcaacatttcaaggacttatggatcacatttttgctgatttattgaggcatggagtgatggtattcatggatgacattttgatttacagccacacattacatgagcatgagttgttgttgcaacaggtgtttcagactctgaatcaacacaagttcttgattaaaagaactaaatgcacttttgctcaaccatccatagaatacttaggccatgtgatttcagcccaaggagtatctattgaaccctccaaagtggctgcagtcaagaactggcctattcccaagaatgtgaagcaactccgaggttttttaggtctcacaggatattataggaagttcatcaaagactatggaattgttagtcgaccactaaccttattgcttaagaagggttcaatgttccggtggtctgagcaacagcaagtggattttcacatgcttaaatag

SEQ ID NO: 1096 - DNA, 2836 bp, Zea mays
ctcctcccctccgtcctctctctctctctctctctctctctctctccctgccgcgtagcccaagttttgtacaaaaaagcaggctggttccggtccggaattcccggacactcacacacacacacacacacaagcccattgcattcgccaaacattcgcccacgcgccattgtagcgcacgagctcccgaagccctcatcgccgtgccgttcgtctcgccggatcgatcgctccgcccctgctcctggctttggtgccgtatgcccgtccgtctccatagggcttgcattctctctgctttgatttgacggtacccagctgaagcacacaaattgcctccgtttgccggtcctgtgcgtgcgcgatcgagttttgttgatggtcatctagcaggatcgcaggagttgacgagccgcacgccctagctcgtacgtgaaaaaaacgtggccacgtttcaggtgctgaaaccaagatggttaatttcggtaagaaattgatggcagaccagttggaggagtggcgagagtactatattaattataagatgatgaagaaaaaggtaaaacagtatgtacagcagacccaaactggtggaaaaaatcgtgaccaggttcttaaggagttctcaaggatgcttgatgatcagattgaaaagattgtgctatttcttctgccacaacaaggtcatcttgctaggaggatcgagaatttaggagaacagcgtgtcgtgcttatggaacggtctgatgtatcccaaatttgtcaaatacgccaggcttacagggaagttggatatgatcttgtgaagctacttaggtttcttgattcgaacgctactggtatccggaagatacttaagaagttcgataagcgctttggctataagtttacagattattacgtctctactcgagcaaaccatccttattctcagctccagcagatcttcaagcaagtgggagtcgtggctgttgttggtgctttgtctcgggggcgtgcttatctacaagatcatcaaggaagcctagcaaatatctatgattacccatcactcatcttgaaggatcccgtcatagaacaaataaatcactcagtacagaaactcacacactccacaagctttctgcaatttctagggcagcatgcacttatcgttccgggggatatgcagagcggctcagatctcggtgatgacaaggattaccatttcctgtcactgctgctgaacctagtaaacacgtttctgtacatggttaacacatacatcatcgttccaactgccgatgactattcagtaagcctcggagctgcagcgactgtttgcggtgtgattatcggatcaatggcagttgcacaaatcttctcctcggtatatttcagtgcctggtcgaacagatcgtacttcagacccctcgtatttagctgcatcatgttgtttctggggaacctattgtatgctttggcatacgatctgaattccctaactgttcttattgctggccggctactgtgcggtttgggttcggccagagccgtgaaccgccgctacatcagcgactgtgtacccctgaaaaccaggctgcaggcgtcggctgggtttgtcagcgctagcgctcttggaatggcatgtggtcccgctcttgccggtctgctgcagacaaagtttaagatttatgggcttacattcaatcagaacaccttgcctgggtgggtcatgtgccttgcttggattgcatatttgttctggctgtggatttcattcaaagagccgggccacattgccacagagaattcagtcagcacgcaatcatctgattctggccgtcgagtaagcggtaacttggagggtggcctcggagagcctttgctcatagacgcaaaggcagggcaggatgaggacgacgaggacaatgacgaccccgaagaatctcatacacctgccacatcgcttgctgcagcatacagattgctgacaccatctgtgaaggttcagctactgatctacttcatgctcaagttcgccatggaaatcctactctcggagtcgagtgttgtgaccacgttctatttcaagtggacaactagtaccgtggcaatctttctggcagttcttggcctgacggttctcccagttaatgtcatcgttgggagctacgtcaccaacctgttccaggacaggcaaatcctggtggcctccgagatcatggtgttgatcggcatcgtcatgagcttctgcttcacccctcactactccgtcccccagtatgtcacgtcagctctcatcacgttcgtgttcgccgaggtgctcgaaggggtgaacttgtccctcctctcccgcgtgatgtcgtcgaggctctcccgcgggacctacaacggcgggctgctctcgacggaggccggcacgctggcccgcgttgccgctgacatgaccatcacggccgctggctatctggggcagggccgcctcctgaacgccaccctcctgccgtccttggtgatctgtctagcatctatcgtcgcgacgttctgcacttacaactcactctactgattaccggtcgatgaactcctctccctcttatacaagttgccgaattgcgtcttgcagtgacgctgaaaattttcgggctgctgctgctaatgtaaactgctgcggcctgcgggtggacgagcggtccatgtgtatcgacgcctgtagtgttgcgaacttgctacggctgtaacatgacacgtgcgcgttaaataaaatgccctactgaagtaccctgtcaaaaaaaaaaaaaaaaagggcggccgctctagagtatccctcgaggggcccaagcttacgcgtacc

SEQ ID NO: 1097 - DNA, 2132 bp, Zea mays
  misc_feature (47)..(47): n is a, c, g, or t
  misc_feature (2009)..(2009): n is a, c, g, or t
acctctgcccctcccgccatctccctctctccccaccacccccccanatccccacccccaccacccccctaggccacccccccgcgccccaccccccccaagctgcccgccccccccttccgcgacttatacgcccccacccggccccgcattgcctcctcgagcagattacgggcccgagccatcgtcatcgagacatcgaccgactccgactccgactccatccacggtctccttccgagatccctcttctcctcccgcccccgcctgaccgcctccctcctcactccggccccttccgcatgtcaatccatgggctgatactcgaagtcagagtcaccgggtgccggaagctgcgggacacggagttcttcacccgccaggacccctacgtcgtcgtcgagtacgccaccaccaagctccgcactcgcacctgcaccgatggaggaagaaacccaactttcgatgagaagttccatatacccctcattgaagggctccgcgagttgaatgttattgtgtggaatagtaatacgttaactcatgatgacttcattggaagcggaagagtatatctgcacaaggtgctgacaaatggctatgatgactcctcatggccgcttcaaacacgccacatgagatctgctggggaagtgaagctcattatgcatgttgatgtctcagcaatgaagaacaagatgggtagaagtgtcgccgcatcaagtgcacatcctgttcctgcactttcaatgccagccccatctccaaccccagccccagccccatctccagcttcggccgcaacccctgctccagcaccagcactagcatcagcgattccatacacgggagtctcaccttcatatccaccggtttcagcatatcctggtgcaaccgcataccctgcttacccaacttctagccatgcaccatataccactgctgaatatccaccacctccgcagcaaccataccaacccccacctgctggataccctccatcctatccaccacaaccatatgagcaatcttacccaccgcaaccatatgagggatcttacccaccacaaccatatgagcgatcttacccaccgcaaccatatgggcaacaaccatacccacccccgccagcagcagagtcgccgtacccaccagcgccttaccctggtacttatccaccaagaccctattgatatagcagcgtcagtaatgatctcaggtagaggcatcaaaagcaacaaacaacagccttgatgctatgtgatacgcgcctcagcgtggattctttatttctaattatttggttatgttcctaacaaaaaatagtaccaaccgtcactgagttgttgcacatctatcacaaatcagtttaaggtcagattccaatcgattggtgacaaattggagctgatggggtttcgttaagtgcaacggatggaaatgtattccttgatcagatcgtgtcaacagctcagtgaccagtcatatgtacaataggtagcttgcagattgtgtcagtgaaatccatcctatattgctttgcagtgggtggtttagagaccagaactagcttccttcttctcctatcttggaatcacatctggactgatctgtgaccacacaattgtacatgtagtagggtaacctgtgaagtctgctgcttttccaaaacaacaataaatctgaatgtatttgtaacagtcaataaatttgctttcttggtgacaaaaaaatccaacaatcatcagccctattacataaattacctttggggcatatatggagacaaaacatatgggcacacaacctacaacaacttgtgctataaaaccttgttgtctactctcagaaacagaagtttttttcatttaaccaactatctgcattgaactctgttttttatttgcaacaacaccacctaccatttagccagatacctgttgtctacccccagaaatttttttcatttaaccaactgtcacaattgaactctcttgtttatttacagnagcaccacctattataatttagccacatatctgtggtgagccctgttacctttttgatacactcacagatgtggcggttttataagaacgctgtgcctatagctgtgaccctcttacacctgt

SEQ ID NO: 1098 - DNA, 2652 bp, Zea mays
atgcctccatggggcgaccaagcagctgctcctaggggtagcacaacaaggggatcagcccaacagcccaatgcccccatgcatggtggaaccctagagcttcacccctttttagcaccagcattccgccgcacgacctcactcaccacaggtcgcattgtagctgctgctgttttcccagtaatttcagctctaattccaggtgtcaacattcaaggtatcaaggaacgcaaacctccagattttgttacctcaaggagaagatacatgaatagaagcatttgccaccacctccttgcccactgcaaaaagctaagagagctccagagaatccacgctctggctgttacccatggtctccaccccaaccatcagtctgtttcctgcaaaatcttccgctgctacgctgattttggccatgtagctgatgctcgcaagctgttcgatgagatcccacaccctgaccttatcttctttactagcctcatgtccctccatctcaagttagatcaccaacgcgaagctatatccttgtttgctcgtgttgttgccgctggccaccaccttgatggctttgcggttgttggtgccctgtctgcctctagtggtgctggtgatctagtggttggtagggcagtccatggccttatttttcggcttggattggatcacgaggtcgtcgttggcaatgcattaatagatatgtatagccagtgtggggagtttgagtctgcggtaaaggtgtttgataggatgtttctgaaagatgaggtcacatggggtagcatgctgcatggtcatatcaaatgtgctggtctggattctgcactgtcgttctttgatctggttcctgtgaggagtgcagttgcttggacaacactgataactggtcatgtgcaaggcaggcagcctgtacgggctctagagctttttggtaggatggtactggagggccatcgccctacccatgttacaatcgtaggtgtactctcagcttgtgctgacattggtgctctggatctagggagtgtcattcatgggtatggaagcaaatgcaatgccagctcgaatataattgttagcaatgctctgatggatatgtatgcaaagagtgggcgcattgagatgtcattttctgtgttccaagaaatccagtcaaaggatttttttacatggacgactatgatctcatgctgtacagtccagggagatgggaggaaagctcttgagctctttcaggacatgcttagagctggaatagttccaaacagtgtaacctttgtttctgttttgtcagcatgcagccatgctggcttgatagaagaaggtagagaattgttcaacagaatgcgtcaagtatacaaaattgatccccgacttgagcactatggttgcatgattgatctgttaggacggggaggattactagaggaagcagaagatctaatagctgatatgaatctggtgcctgatattgttatatggaggtcacttcttagtgcatgtctggttcatggcaataataggctggctgagattgctggaaaggaaattataaagatagagcctggagatgatggagtttatgtgctactttggaacatgtatgcatcatcaaataaatggagagaagctcaagagttgaggcagcaaatgttgactcttgaaatcttcaaaaaaccagggtgtagttggatagaacttgatggtgttgtccatgaattcttggtagaggacaagacacatgatgatcgaagggaaatttatgaaaccttggaatacatgacaaggcagctcaagacacatatcagattatcctcatgggagcaacatgttgtcaggtcaaagaaatgcctaattcaagctcacatggttgcacatcataaggatgaacttgataaatcagaaatatacaactcagatggggaaaagattgttcatgagcaggaacataggtgccaagagtgtggccgttgtttccagaaaccagctcatctgaagcagcacatgcaaagtcactcacatgaggaggacggctgtaacaaggttttcaggtattcatcaaagctgaagaaacatgaggaatctcatgttaaattggactatgtggaggtagtgtgctgtgagccaggttgcatgaagatgttcagaaatgttgaatatctgagggctcataaccaatcttgccatcagtatgttcagtgtgagatatgtggagaaaagcacctgaagaagaacatcaagcggcatctgcaatcacatgacaaggtgccctctgatggaaggatgaaatgcacttttgatggttgtgaacacttcttttccaacaaatcaaatctgaccaagcatgtcaaggcatgccatgaccagctgaaacctttcaagtgcggaatcgttgggtgtggcaaggcgttcacctacaagcatgtcagggataaccatgagacatctggtgctcatggagactttgaagagttggatgagcagttgcgtgcccggccaagaggtggtcggaagaggaaagcattgacggtggaaacactgacacgcaagagggtgaccatctccggcgaggcttcatccttggatgatggagtggagtatcttcgctggttgctatctggtggggatgattcaattgattgtcagtag

SEQ ID NO: 1099 - DNA, 1046 bp, Zea mays
  misc_feature (732)..(732): n is a, c, g, or t
  misc_feature (799)..(800): n is a, c, g, or t
gacagagaacatgtcttattctattctattcttacatggtatccactcaagttcacaactacgacaaatggagccaactcttcaccattgttcttggtcgctttgatcttctccaccatatcactaccttttatgctttcccggataatctatgcttttcaccagttgacacaaactctaagtcctcttcttctgctgtatctctcctttcacaacccactgtttacagaagcttagtcggtgctttacaatatctcacttcaactcgaccagatatttcctatgatgttcaacaagtctgcctttttatgcatgctcctcgtgacactcacatggctttgctgaagcggatcttacgctatgtgcgcgtcacactggactacggtcttcattcccaatcttgatgctgacatgggctggatgtccagatcctcgacgttccacatccggttattgtgtatttctgggtgacaatcttattgcttggtcctccaagcggcaacatacagtttctagatccaatgcaggcgtggcaaatgctgtggcggaaatgtgccggttgcgtcagttgatgactgagctttctcatcccccctgtcgtgcatctgtggtattctgtgaaaatgtcagtgtgatgtatctagcccccaaccctgtgcaacatcaacatacgaagcatgtggaaattgacttcccttttgtgcgtgagaaagttaggggaggtgccggtgncccattttccctcctcccttccgttggcgggttttttttcccaagggctgccttcctctttgttccnnggttttcggtgccccctcccggtcccgccctttttgggttccgtcggttgagggggggtgtttgcctttgtctcgcttttttttctgttggctggctctttttcttccttgtgtgccgggtcctccggctctttaaaaaaaaaagcgtgtgtgctccgagtcttctagctctatctgagtcttctggctctatctcatgtaatcaggtttatatatattttgtataccgaatgccaatcccccgat

SEQ ID NO: 1100 - DNA, 1412 bp, Zea mays
aaagcaccgcacatacctcctgcacccccgacatccatcgatcgatcgatcgagctgtagcaacaaggaggagatggggaggtccccgtgctgctgccacgacgccggcgtcaagaaaggcccgtggacggaggaggaggaccgcgccctggtggaccacatccagaggcacggcggccacgtcagcagctggcgcaacctgcccaaggccgccgggctcaaccgctgcggcaagagctgccgcctccgctggaccaactacctccgccccgacatcaagcgcggcaacttcaccgacgacgaggagcgcctcatcatcggcctccatgcccagctcggtaacaggtggtcgacgatcgcgacgcacctggacgggcggacggacaacgagatcaagaactactggaacacgcacatccgcaagaagctgctgcgcatgggcgtcgaccccgtcacgcaccagcgcctgccccccgacgacctgctgctcgccgtctccgcctcccccacgacgacgatcctctcggcggcggcgagccagctgcggggcctgaacaccgctctcatgcaggtgcaagcgctgcagtttctgctgcaggccgtcagtggagttggaaacgacgttaacgccgccgccgctgctgctaatggtggtggtggtctcgtccctagcctcagcgcagccgcagataataacgccgttctgaacgcgagccgtagcgtcgttccaggcttccaggacctgcagctgacgacgatgaccaggcctcttctcgtgtctcacgcgaatcacgggtcagctgatcatcatcccagctacatcgcaactgatgatgtggtgcagcgacgactgaacgcttcggctcctccggtggtcggcggcggcgcctgtgcagagccgctggctgttgcattggcgtccacggcttatcgacaccaagtggcagctgccgctgacgagccggtgaatggttttgccgagctaatactgtcggagcccatcgagatgccgagcatgtgctctctggaggacgaagatcatttctggaaggacatgctcgtagagagcagcagcttcagcctgccactatgaaatttccaagcgtgggaacgggaggacgactggcggtgaatgcatgtgttgtacaaaatcgtgtgattatctcaatgtttctttaactagcttcgcattgtcacttggtatatctatctgtgatctgtgtgcagtgtgtatttcacccacctcatataccagtgacatttccaagcgtgcagtgtgtattttacctatacccatacgaatatagttaatagaatactaacaatgtgtatcttgtttttttgaaaaaaaaaaagggcggccgctctagagtatccctcgaggggcccaagcttacgcgtacccagctttc

SEQ ID NO: 1101 - DNA, 1610 bp, Zea mays
cagagccccgagcaatcccttctcgcccttttcacttttcagatccagccagccagccagccatcccactccgcaccgcattcctcgcagtggcagagcttgcagcggtggtctcttccccttcctcctgtctcctcctcgctcgatctcctctcccaagcagcgagaagcggatggggagggcgccgtgctgcgagaaggtggggctgaagaaggggaggtggaccaaggaggaggacgaggtcctggcgaggtacatcaaggagcacggggaaggatcgtggaggtcactgcccaagaatgccggggggctgaggctggttttgctggcagggctgctgcggtgcgggaagagctgcaggctgcggtggatcaactacctgcgggcgggtctcaagagggggaacatctcggaggaggaggaggacatgatcatcaagctccacgccacgcttggcaacaggtggtccctgatcgccggtcacttgcccggtcgaacagacaacgagatcaaaaactactggaactcgcacctgagcaggcgggcggccgacttccgcgacggcgtcgtcgtcgacatcgacctcagcaagctgcccggcggcgggaaacggcgcggcggccgggccagccggggcgccgtcgtggccgcggccaaggagaagaaggccaaggagaaggacgacaggggcaatagcaaggtcgcagaagcggagcagcagctcagggacacggaggacgacgacggcggcagcgtctccacgccgaggcctcagtctgatgactgcggcaccgcccagagcgaagaggagcaagcgcaggccagcgccagcggcctgacatccgatgggcatgggcccgaggaggaggaggaggaggacccgctggctctgagcgaggagatggtgagtgcgcttctggccccggaaagcccaaagctggaggtgggccccgatggctcgtgcatggacagctacagtggccctccgtcaggggaaagcggctgtgggtccagtgggccttctggcgacgtggcccaggacctggacctagacgacgacaaggccatcatggactgggacttgatggggctggacatctcgaccgccggtgacatgtgggaccagctggtgtgggactacgacgaaacgttggtcacggaaccggaaggaggggaggaagggcaccagcagcaggacgatgtcatgtcagacctcttcttcctggacaatctctaggaggtgcgaggatagcatgggcatggctgccgtgatgctttatgctttttaatttgatccggtacttgtaggtttttgggtgtgttcagttcagagatgagtggcggtgtcagagacgagataaggggagtgctccagtgacatctttgtttgctggccggatctcacgaacccgtagaatggcaagaatgtagaaaaataagcacgcaatatcacttggaaacctttcatcagtagagcctgtctaacatctacagacggagaaatgcaaaaaaaaaaaaaggttgctgggattgccatagtctgctaatccttaggtcttttcttttgacaaacacgattgctttattaattgattcaagtcatgattac

SEQ ID NO: 1102 - DNA, 1773 bp, Zea mays
acaagtttgtacaaaaaagcaggctggtaccggtccggaattcccgggatgcggcctcgcgccacggcgcccactttgccgggcgcgcccacgtgcccgcgccagcagccacacgtacggccgcgcgccgccgtggccgtggccgtgccggcccgctagctactcgctctcgctccgctccccccacttaccgtccgcccaggtaacggagcatccggtcggttacgtgtacgcgctagcgtactctactccgtgtacccgcgagcccggccgctgctactatattatggccggccgtgtcctaatcgaaaaattagccagcgagctgaggcctgaggagcgagcacagccgagtcacccggccggccgcccgcacgcacggacaccaacaactcccttggacgcacccgatcgaccctgctgcctgctagccgtgcgcagtagtgggagcgagcacgagtgagagtgggcagcgagaacatacgccgcccccggccggtgtgactggtggtggcgtcgcgcgcgcgatggggagggcgccgtgctgcgagaaggtggggctcaagcgcgggaggtggacgaaggaggaggaccagatactcgccaactacatcgcagagcacggcgagggatcctggaggtcgctgcccaagaatgcagggctgctccgctgcggcaagagctgccgcctgcggtggatcaactaccttcgggccgacgtcaagagggggaacatctccaaggaggaagaggacgtcatcatcaagctccacgccacccttggaaacaggtggtccctgatcgccagccacctccccggccgaacagacaacgagatcaagaactactggaactcgcacctcagccgccagatccacacgtaccgccggaaatacaccgccggcccggacacggcgcccatcgccatcgccatcgccatcgacatgagcaagctgcacagcgccgagaggcggcgcggtggcaggaccccgggccggtcgccgaagagcgccaccagcagcagcagcatgaccaagagcaagcagccggacgaccctgagccagaaccggaggccggcggcgcgtccagcccgcggcacagcgacggggcgcgaagcgccgtggtggacccggacccggacccgaaccagcccaacagcagcagcggcagcggcagcacgggcgagggggaggacgcgacggggccgtgggtgctggatccgatcgagctcggggacctctgggaggccgagagcgagatggacgccctcatgtctatcgggggggctgcccacgactcggccaccgcggaaggattcgacgcggcccaggcccaggtggacgacctgttcgacgacatggactgggataacttcgcggcccatctgtggggggagccggagcagcagaacgaccacagcgcgcagccgcagccccagcaggccgccgagccgcaggctgctgctgctgctgatgtggcggcggcgggggcggaggcctgcgacccggacgaacacgaactggaggcgttggaaacttggctcctgtccgactcgttctgacagttcccgtcatcagataccgatcaggtcgacgcagctagctagggcctaggtgttgctccgtgcgtgcagtttcgtgtaaatttcgtttctagttcgtaaataggtgctggttcgtgcaaaaaaaaaaaaaaaaaaaaaaaaaaaaaaaaaaaaaaaaaaaagggcggccgctctagagtatccctcgaggggcccaagcttacgcgta

SEQ ID NO: 1103 - DNA, 471 bp, Zea mays
acagtctcctcggtaacaagtggtctttgatagctggaagattgccggggagaacagacaatgaaataaagaactattggaacacgcacataagaaggaagcttttgaacagaggaatcgaccctgcaactcataggccactcaacgaagctgcaactgctgcaactgttacaactaatatatcttttggcaaacaacaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaggattgcagctgcaacgtttccaacgctgtcactgtcaacaacaccactccttcttctgctgctgctgctgctgcttatgatttcttgggcatgaaaaccagcggtgttt

SEQ ID NO: 1104 - DNA, 1815 bp, Zea mays
agccagcacagcacacacactggaaagtgcaagctgtagtgagacctgcgcgactgccagcgtgtatccgcgcggcaaggagcgtagcgcgcggtcgtcggcccgcacggccaccaactcccttggacgcacgcgcgcgcgcgaccagctgctaaccgtgcgcaagtagtagtgcgacttcgccgccggccgggatcgctagctcgatcgatcggcgggaccacatacgactccggtgtggccagcggcggccgggccggggaacgcacgtgctgcgagcgagcgagggcagacgctagctgttgccgggagctagccggcgcgcgatggggaggacgccgtgctgcgagaaggtggggctcaagcgagggaggtggacggcggaagaggaccagttacttgccaactacattgcggagcacggcgaggggtcctggaggtcgctgcccaagaatgcaggcctgctccggtgcggcaagagctgccggctccggtggatcaactaccttcgggcggacgtcaagagggggaacatctccaaggaggaagaagacatcatcatcaagctccacgccaccctcggcaacaggtggtccctgatcgccagccacctccccggccgaacagacaacgagatcaagaactactggaactcgcacctcagccggcagatccacacgtaccgccggaaatacaccgccgggcctgacgacaccgccatcgccatcgacatgagcaagctgcagagcgccgacaggcggcgcggcggcaggaccccgggccggccgccgaaggctagcgccagcaggaccaagcaggcggacgccgatcagcccggcggcgaggcgaaaggcccggccgcggcggcgtcgagcccgcggcacagcgacgtggtgaacccgggcccgaaccagcccaacagcagcagcggcagcacgggcacggccgaggaggaggggcccagcagcgaggacgcgagcgggccgtgggtgctggagccgatagagctcggggacctagtctggggggaggccgacagcgagatggacgccctgatgcctatcgggcccggcggccacgactcggctgccctcgaagggcttggcgcggtcggctgcgaggcccaggtggacgacctgttcgacatggactgggatggcttcgcggcccatctgtggggcgggccggagcaggacgagcacagcgcgcagctgcggcaggccgccgagccgctggaagttgctgctgctgctgctgctgcgacggcggcccgcaccccggacgatcgcgagctggaggcgttcgagacttggctcctgtccgactcgttctgacggctccggtcaccggaccgatcagacagaccaaataattgggtcacgtgtgctcgctcgctcgctcgctgccgtcgcgtgggtcttggttcagatggccaaataattgggaaaaaaattctacgcggcagggccgtaaagccaccaccgtgcgctcctgatgtcgatgcctgccgcgtggagctcttgcgtatctaacgctcccacgacaatcacccttccagacggctcgaattacatacgacaggatcggctccgctctactccgttctgttcgcttctgctttaggtgcgtgcctagcagatggtgaggcggcgtcgcgcggccctcccgacggctcgccggccgcgctacggggcctgctgcagcagcccctcctccacgcctgtaaaagagctttgtatttacctgtttgtttgtgcttttgtgcaatggaataaacaatgatattatactgaataaacatgaatgttctgagac

SEQ ID NO: 1105 - DNA, 1567 bp, Zea mays
aaacaaaaccctcctcgtcatccgcggccgcttttcccctgacccctgtctcgaccaatcctccctcccacacacatcacacccacaagacaaaaaaaaaaagcgcctttgagcgccgcgcgatctctggtgcttggtgtcgtcgcgacaccagcgttagtttctgtttcagcgcgcacgcgcgtttgtgctgtgggggttgggaagagccgaagagcgaggcggcagcgcgatcgagcggttcggcgggcggcggccgatccgatgggaagggcaccctgctgcgacaagaacaagggcctcaagaaagggccctggacgccggaggaggacaagctcctcgtcgactacatccagaccaacggccatggcagctggcgcctgctccccaagctcgcagggctgaaccggtgcggcgacgagctgccgactgcggtggaccaactacctccggccggacatcaagcgcgggcccttcacagccgaggaggagaagtccatcgtccagctccacgccatcgtcggcaacaagtggtccatgatcgcggcacagctcccaggccggacggacaacgagatcaagaactactggaacacgcacctcaagaagcagctgcgtcggatgggcctcgacgagcccccgcccggcccggccgccggctgccccgccgcgcgccacatggcgcagtgggagacggccaggctcgaggccgaggcgcgcctctccctcctcgccgccaccgccgcctcctccggtaccactgcgaccaccacagccaccaccaccacgtctgcagcctcctcgtcctccaccaccgtcgctggcgcggccgacaacaaggcctccaaccccgcggacatcttcctgcgcctgtggagctcggacatcggggactccttccgccgcaagacggacacgacgccagcggtgcccgcgcttcccggcgcccgtcgtcaagaggaaggacacggcgatcaagcaggagccgcgggcgctgctgctcggcctcggggacgactcctcggcggcgtccaacgacaacgagacggaggtggcggaggcgctggaggcgaagtaccagatgttcctcgacttcgcgggcgaagagctgggattgttccatggccggcacggcggcttctcgctgttcccgccgctcgacgtgctcgctgaggcgtccctggactcggctttcaagtgaagacgtagccagcaccacgtacgtacacggtactcatacgtacggcaagcggcagtggccaactggccatgcctctacggcttagctatacgcctcgaaatgcgcgcatggatgtatatagatatgcgtgtgactgcactggcatatcggcaattttttgggttaggccagcaagtgcgtggtttagcttgttattatgcagggttggttttggtaggacatcatggtgtatgggggattctctgttcattggagatgctctaatacatcacgagatgttcttcaatcttcggcaaaaaaaaaaaaaaaatagattctgggactgctttttcgcactggaaacatatttgacctggtttttagag

SEQ ID NO: 1106 - DNA, 894 bp, Zea mays
atggggaggtccccgtgctgctgccacgacgccggcgtgaagaagggcccatggacggaggaggaggaccgcaccctggtggagcacatcaaaaggcacggcgggcacgtcagcagctggcgcgacctgcccaaggccgccgggctgaaccgctgcgggaagagctgccgcctccggtggtcgacgatcgcgacgcacctggacgggcggacggacaacgagatcaagaactactggaatacacacatcagaaagaagctggtgcgcatgggcatcgaccccgtcacgcaccaacgtctgcccccggaagacattatcgcctcccctatggcgatcctctcggcggcggcgagcctgggaggcctccacagcgctctgatgcaggtgcaggcgctgcagcttctgctgcaggccgtcaataacgacggaggaagaagcgctgctgccggtggtctcatcatgcctgacatcctcaacgcggccgcagataacgccatccttattaataacgcgagtcgtagtagcgtcgtcccgagcttacaggaccagacgaacctccccgccgcgtctcacgcgaactactacggttcacctgatcaccatctcagcagcaacatcgcgagctttgcagatcagcagcacgacgacgcttcggctccggtggtcggctgcgcgtacgcggagccgctggctgctgcattggtgtctgccgcttatccgcaggaagtggcagccgcagctgaggggtggccggtgcagggtttcgccgagcttctgtcggggcccatcgagatgcaggtgcagacgaaggcgaggacgtgctccctcgaggaggacgaccaagatgatttctggaaggacatgctgctagagagcagcaggttgccgctatga

SEQ ID NO: 1107 - DNA, 1526 bp, Zea mays
atgctacgccaagcscgcaattaaccctcactaaagggaacaaaagctggagctccaccgcggtggcggccgctctagaactagtggatcccccgggctgcaggaattcgcacgagaccattacctagaacatcctaatcgaaaagcacctcgagcaccccccggcccgtcgtctacagtctacagcacacatcgcagcagctcgcgaccatcgtccatccgctcaattgtgatcgatcgagctgcgagcccatcgcctctagctaagctaccatgggtcggcagccgtgctgcgacaaggtggggctgaagaaggggccgtggacagcggaggaggaccagaagctcgtcagcttcatcctcggcaacaggcagtgctgctggcgcgccgtgcccaagcttgccgggctgctgcggtgcgggaagagctgccggctgcgctggaccaactacctgcggccggacctcaagaggggcctgctctccgacgccgaggagaagctcgtcatcgacctgcatgctcagctcggcaacaggtggtcaaagattgcgtcgcacatgccaggacgaacggacaacgagattaagaaccactggaacacccacatcaagaagaagctcaggaagatggggatcgaccccctcacccacaagcccctcccgccgcctgatccgcatccgccgaaggaccaccagagcccaccgcacaccgccacaggtggctcgccggaagcgccgccatctccgtcgccgaagcctccacaggagaagacggcagtaccggtgatgacgccagctagccagcaagaagcaggtgacgatgacgtgccgctcctcagcaactactacccaggcttctgcaccgacgaggtacccatgatggacccggacgagatcatggtgcctctggacgacgggcggacggcgccgccgacgtcgacgattttctcgaccacgaccacgacgtcctactctgcagcctccgactccgtgtcgtcgtccttgagccgcgacgaggacccgctgttcccgctcatggacttggagttccccgacatcgcgttccagatggggctactagacgacatggtcgcgtcgtgggacgactccttggcgcagcagccgctgtcgccatcccctgtctacgacgacgactatgcaaaccagctgcagatcaggagcggcgttgcgtttgaccaggagccagggaacaagattgtgctcttctctagctattaggcagttaacccctttaataaatgagatatgcacctccttacaccttactggtcactgcactaaactagcaaattactccgacacgacggttgttcattctgttaactgcaactgctttctagttatataatcaagatttgttaaaccaaaaaaaaaaaggtgataatcacataatacgccaaatagcgctagctgttttttaaaaaaaaaaaaaaaaaaaaaaaaaaaaaaaaaaaaaagggcggccgctctagagtatccctcgaggggcccgaagcttacgcgta

SEQ ID NO: 1108 - DNA, 489 bp, Zea mays
  misc_feature (483)..(483): n is a, c, g, or t
atcaacagttttaaaaaaagacataactcaaccaatctcactttgaaaaagacatgaacaaaacccgccttcgtgctctctccccaccttccggtatgcaacaccgtaagagatgtcgattgagaggtcgaaactacgtaaggccagaagttaaacaacgcaacttctcaaaagatgaagacgatctcatcctcaagcttcatgcacttcttggcaatagatggtcattgatagcgggaagattgccaggacgaaccgacaacgaagttaggatccattgggaaacttacctaaaaaggaagctcgtaaaaatgggaatcgacccaaccaatcatcgtctccaccatcacaccaactacatttctagacgtcacctccattcttcacataaggaacatgaaaccaagattattagtgatcaatcttcttcggtatccgaatcatgtggtgtaacaatttcgttggtctggtattggagaattncgaact

SEQ ID NO: 1109 - DNA, 1398 bp, Zea mays
aattgcttcgaacccacttgatcgctgcgtcgtctcccgggccggccctcagcgagctctcccgtacgtgcgcagttctcggcacgctaccccttatataccccccggccgctctcgctctagatgcacaggcagtgacacgcgcgcataccgacggactaggtagctgctcatcagctatccagatcgttgctcctcccttccctcgccatcggccgcgcccgtgtcgggcggcgggcgggaatgggacgccacgcggcctccggcggcggcgtgcagcagaagctgcgcaagggcctctggtcgcccgaggaagacgagaagctctacaaccacatcatccactacggcgtcgggtgctggagctccgtgcccaagctctcagggctgcagaggtgcggcaagagctgccgccttcggtggatcaactacctgcgccccgacctgaagcggggcagcttctcgcagcaggaggaggacgccatcgtcggcctccatgagatcctgggcaacagatggtcgcagatcgcgtcgcacttgccgggccgaacggacaacgagatcaagaacttctggaacagctgcctcaagaagaagctgcgccagcgcggcatcgaccccagcacccacaagcccatctccgccgacgcggcggcattggagcagccggcgtcgcgagaccgcaagccgtcgttggccacagccgccgctggtggcggcctcgacgtgaagcagcatcagcagcagcagcaggtgttcgacccgttcccgctgaccgacagcttcggcggcggcttcgacgacgcggccggcgccgcattgtacggccacatgggcggcggcggcaagcagcaggacgcggccgcgttcgtggactacagcagcgtgctggacgtgtcggagaacctgggctacggcgagagctccagcaacagcagcaacaactggaactgcgcgccggaggtgaacaacaacaacaatgcgctggacggcggcgacgcgccgctgcactgggcctccgagagcaaggccgcgcccttcgccggctacggcgccgaggagcagtcgctgctggagcacaagctccttccgcatttcgacttcgacatcggccgggccgccgtggtcggcgacttcagcctcgacttcttctgaagggttcttcagccctgcgggtataatcatcgatcgccgtgcccgtgtatgtactgtatcaaagccaattcatacggaacagtcgggagcttagagaccgcgctttgttaattctcctctagtcgtccttactcagcagctctcctcctttaacaatgttttgggcttcttcgtttcaaaaaaaaaaaaaaaaatgtctaaaataaaggcatatacatataaaaaaaaaaaaaaaaaaactcg

SEQ ID NO: 1110 - DNA, 780 bp, Zea mays
atggggaggtccccgtgctgctgccacgacgccggcgtgaagaagggcccatggacggaggaggaggaccgcaccctggtggagcacatcaaaaggcacggcgggcacgtcagcagctggcgcaacctgcccaaggccgccgggctcaaccgctgcggcaagagctgccgcctccgctggaccaactacctccgccccgacatcaagcgcggcaacttcaccgacgacgaggagcgcctcatcatcggcctccatgcccagctcggtaacaggtggtcgacgatcgcgacgcacctggacgggcggacggacaacgagatcaagaactactggaacacgcacatcaagcgcaagctcctcgcccgcggcatcgacccgaagacgcaccgcccgctcggcgccggcgccgacgccgccgcgccacccggcgtggtcgcgcaccgggcgctgctgcaccgcgcagccctcgtcgagctcgccgtgaagccggcgccggcggagtcatccgacgacggcggccggagcagcggcaccagcagcggcggcggcggcggcgccagcgtggaggagccgcggtgccccgacctcaacctcgacctgtccgtgggcccgccagcggccgccgacacgcccacctcgacctcgcagtcgcagctggcggtgtgcctgtgctaccgcctgggcctccgcgccggggacgcgtgcggatgccaggctcaggctgacaacgcggggttcagattttcagagctcagaaccgagaggagagtcgttaagtag

SEQ ID NO: 1111 - DNA, 883 bp, Zea mays
gaagaggcagaccgcagatggggaggtccccgtgctgctgccacgacgccggcgtgaagaagggcccatggacggaggaggaggaccgcaccctggtggagcacatcaagaggcacggcgggcacgtcagcagctggcgcgacctgcccaaggccgccgggctgaaccggtgcgggaagagctgccgcctccggtacggtggaccaactacctccgccccgacatcaagcgcggcaactttaccgccgacgaggagagcctcatcatccacctccacgctcagctcggcaacaggtggtcgacgatcgcgacgcacctggacgggcggacggacaacgagatcaagaactactggaatacacacatcagaaagaagctggcgctgcagtttctgttgcaggccgtcaataacgacggaggaagaagcgctgctgccggtggtctcatcatgcctgacatcctcaacgcggccgcagataacgccatccttattaataacgcgagtcgtagtagcgtcgtcccgagcttacaggaccagacgaacctccccgccgcgtctcacgcgaactactacggttcacctgatcaccatctcagcagcaacatcgcgagctttgcagatcagcagcacgacgacgcttcggctccggtggtcggctgcgcgtacgcggagccgctggctgctgcattggtgtctgccgcttatccgcaggaagtggcagccgcagctgaggggtggccggtgcagggtttcgccgagcttctgtcggggcccatcgagatgcaggtgcagacgaaggcgaggacgtgctccctcgaggaggacgaccaagatgatttctggaaggacatgctgctagagagcagcaggttgccgctatga

SEQ ID NO: 1112 - DNA, 1485 bp, Zea mays
tacaaaaaagcaggctggtaccggtccgggattgccgggatcgagcaccccccggcccgtcgtctacagtctacagcacacatcgcagcagctcgcgaccatcgtccatccgctcaattgtgatcgatcgagctgcgagcccatcgcctctagctaagctaccatgggtcggcagccgtgctgcgacaaggtggggctgaagaaggggccgtggacagcggaggaggaccagaagctcgtcagcttcatcctcggcaacaggcagtgctgctggcgcgccgtgcccaagcttgccggtgcgtatctatctatctatgtacgtgcatgctcgatcgatcgtcgcagcttttgtcatgacgagagaagcttgtcgcgcgttgccatgccatgcagggctgctgcggtgcgggaagagctgccggctgcgctggaccaactacctgcggccggacctcaagaggggcctgctctccgacgccgaggagaagctcgtcatcgacctgcatgctcagctcggcaacaggtggtcaaagattgcgtcgcacatgccaggacgaacggacaacgagattaagaaccactggaacacccacatcaagaagaagctcaggaagatggggatcgaccccctcacccacaagcccctcccgccgcctgatccgcatccgccgaaggaccaccagagcccaccgcacaccgccacaggtggctcgccggaagcgccgccatctccgtcgccgaagcctccacaggagaagacggcagtaccggtgatgacgccagctagccagcaagaagcaggtgacgatgacgtgccgctcctcagcaactactacccaggcttctgcaccgacgaggtacccatgatggacccggacgagatcatggtgcctctggacgacgggcggacggcgccgccgacgtcgacgatttttttgaccacgaccacgacgtcctactttgcagcctccgactccgtgtcgtcgtccttgagccgcgacgaggacccgctgttcccgctcatggacttggagttccccgacatcgcgttccagatggggctactagacgacatggtcgcgtcgtgggacgactccttggcgcagcagccgctgtcgccatcccctgtttacgacgacgactatgcaaaccagctgcagatcaggagcggcgttgcgtttgaccaggagccagggaacaagattgtgctcttctctagctattaggcagttaacccctttaataaatgagatatgcacctccttaccccttactggtcactgcactaaactagcaaattactccgacacgacggttgttcattttgttaactgcaactgctttctagttatataatcaagatttgttaaaccattaaaaaaaaaaaaaaaaaaaaaaaaaaaaaaaaaaaaaaaaaaaaagggcggccgctctagagtatccctcgaggggcccaagcttacgcgtacccaagctttctttaca

SEQ ID NO: 1113 - DNA, 873 bp, Zea mays
atgggacgccacgcgggctccggcggcggcgtgcagcagaagctgcgcaagggcctctggtcgcccgaggaagacgagaagctctacaaccacatcatccactacggcgtcgggtgcggcaagagctgccgccttcggtggatcaactacctgcgccccgacctgaagcggggcagcttctcgcagcaggaggaggacgccatcgtcggcctccatgagatcctgggcaacagatggtcgcagatcgcgtcgcacttgccgggccgaacggacaacgagatcaagaacttctggaacagctgcctcaagaagaagctgcgccagcgcggcatcgaccccagcacccacaagcccatctccgccgacgcggcggcattggagcagccggcgtcgcgagaccgcaagccgtcgttggccacagccgccgctggtggcggcctcgatgtgaagcagcatcagcagcagcagcaggtgttcgacccgttcccgctgaccgacagcttcggcggcggcttcgacgacgcggccggcgccgcattgtacggccacatgggcggcggcggcaagcagcaggacgcggccgcgttcgtggactacagcagcgtgctggacgtgtcggagaacctgggctacggcgagagctccagcaacagcagcaacaactggaactgcgcgccggaggtgaacaacaacaacaatgcgctggacggcggcgacgcgccgctgcactgggcctccgagagcaaggccgcgcccttcgccggctacggcgccgaggagcagtcgctgctggagcacaagctccttccgcatttcgacttcgacatcggccgggccgccgtggtcggcgacttcagcctcgacttcttctga

SEQ ID NO: 1114 - DNA, 1346 bp, Zea mays
ccgcaattccggttgccttctactcacctcctcgtgctcgaggtcgatcccgagggagcccgactcccctaaacccattgtgtgcccgccgtcgacgcagcctccgtcctcccccgcatccgaatcacgcacgccacgtcccacccctgtcatggccacctccagcgacggcggcggcgaccagcggcgcctcctctccatccccaaggaaggcgagcgcatcatcgcgcccacgcgccgccccgacggcacgctccgcaaggccatccgcatccgcgccggttacgtgccccaggaggaggtcgccatctaccagtccaagggcgccctaatgaggaagtcagggcccgacgtgccgccggggtacgacccggcgctagtggccgacgccaaacccaagacgaaggcggccaaacggaacgagcgacggaaggagaaacggcagcagcaggccagtttggcaaatgataaaggaaagagtatgaacatagagggaactgatgctggagaaaccgacaaggtcctttcttccaaaacggataagcagaaggattccgtggaaagtgtaacaaagcagatgagtggcattgctatttctgagtcacatgcaatgccgtccacaaatactataaacaattcgcaaccagaatcatctgctccagacatagacaagaagattcgagcactgaaaaagaagatacgcttagctgaagcacaagtacaaggcgaccctgaaaaattgaaatctgaaacgctggaaaagattaaaaagattgatggatggtgtatggaactgaagcttttggaggacagcagagctcctgcggcctagacaaaatcgacttcggctctgatgtagtagaatagacagtagagccatcgcgaccacaccagggtgctgagctaaattccaaggtgcactgaatcaccctaggcttttccattacctgtgttggttactggaaaaccagtccggtagatgcgggtttgcgcagaacgatggagtgtttttccctgcacatttgatgtctcatgttcgccaccaagtttcaaggtttgtaccacaagatccatttatcagaaagaccacacagtgagataattcaaacgattattgtgacagtgtggttaaactttagtatactatgctaattctgggaatctcttaagactgaatcagaatttacttttgctctcacggcccgaattcatctccggctttaccaccattgttcaattagctgttatatcacggttgaaactgactggaagtgccggaattcttatgtccctggctccctgactctcttcgttatatgtactacctccgttcttgaatattttta

SEQ ID NO: 1115 - DNA, 20 bp, Zea mays
tgacagaagagagtgagcac

SEQ ID NO: 1116 - DNA, 20 bp, Zea mays
tgacagaagagagcgagcac

SEQ ID NO: 1117 - DNA, 640 bp, Zea mays
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaaggtagggcaacttgtatcctttggcaattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 1118 - DNA, 485 bp, Zea mays
catcaggtaggcgcggcgcggaccgcaacacgccagctttcttgctcttgtctctaagcagcagcagcttcctgtctctccagccaccattccattctcgctccttggtaatgaggctggctagccagctaatgcagctccgaacctgttttgttggtggtcatttaaccatgcatgcttcgatcgatggattggtgcatgcatggattattgcatagtgtgatgcatgtggcgcatcagtgcatggttagatgaccatcagcaaacatgttcttgaggcatgcaagttctctagctacacatatcagagatcgatcaccactgcggcgccatggctacttaattgaaatggaggtttgcatttctccgaacccggatgtcgtgattctgcttccgttcttgatccaggatcttccggtcttgttcccaccattactttccttaggaaactggaatggtttcaaccttaatttgtttgtgtgtgt

SEQ ID NO: 1119 - DNA, 1182 bp, Zea mays; identical to SEQ ID NO: 16

SEQ ID NO: 1120 - DNA, 640 bp, Artificial sequence
  Synthetic construct
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaaggttgctctctatccacttctgtcaaattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 1121 - DNA, 220 bp, Artificial sequence
  Synthetic construct
aggctggctagccagctaatgcagctccgaaccgatgcttctctgacttctgtcaccatgcatgcttcgatcgatggattggtgcatgcatggattattgcatagtgtgatgcatgtggcgcatcagtgcatggtgacagaagtcagagagcatctgttcttgaggcatgcaagttctctagctacacatatcagagatcgatcaccactgcggcgccat

SEQ ID NO: 1122 - DNA, 1182 bp, Artificial sequence
  Synthetic construct
atggactgcaacatggtatcttcgtcccagtgggattgggagcatttgatcatgtccaatccgtcaaggactgaagatgacagcaaacagctacctactgagtgggaaattgaaaaaggtgaaggaattgaatctatagttccacatttctcaggccttgagagagtcagtagtggctctgccaccagcttctggcacactgctgtatcgaaaagctcacagtcgacctctatcaactcatcatctcccgaagccaaacgatgcaagcttgcatcagaaagttcccctggagattcttgcagcaacatagactttgtccaggtgaaggctcccacagctctcgaggtatccgttgcctcagctgaatcagatctttgtttaaaactaggaaagcggacatactctgaagaatactggggtagaaacaataatgaaatttcagcggtttctatgaagttgttaactccatctgttgtcgctgggaaatccaaattgtgtggtcagagcatgccagtcccgcgttgccaaattgatggctgtgaactggatctctcatctgctaagggttatcatcgtaagcacaaagtctgcgaaaagcattcaaagtgcccaaaagttagcgtgagtggcctggaacgtcggttctgccaacagtgtagcaggttccatgctgtctctgaatttgatgagaagaaacgaagctgccgaaaacgtctttctcatcataatgcgaggcgtcgtaagccacaaggagtattttcaatgaatcccgagagggtgtatgatcgaagacagcatacaaatatgttgtggaatggggtgtcccttaacgcgagatctgaagaaatgtatgaatggggtaataacacttatgatacaaagcctagacaaacggaaaaaagctttactctgagcttccagagaggtaatggctctgaggaccagctggttgctagtagcagccgtatgttctctacatctcaaacctcaggtgggttcccagcaggaaagtccaagtttcaacttcatggcgaagatgtgggagaatactcaggagtcctccatgaatctcaagatatccaccgagcattgagcttgttaagtacctcttcggatcccctggcccaaccacatgtgcagccattttctctactctgttcatatgatgttgtaccaaaatag

SEQ ID NO: 1123 - DNA, 11 bp, Zea mays
ggccccccgca

SEQ ID NO: 1124 - DNA, 11 bp, Zea mays
ggccccccgca

SEQ ID NO: 1125 - DNA, 11 bp, Zea mays
ggccccccgca

SEQ ID NO: 1126 - DNA, 11 bp, Zea mays
ggccccccgca

SEQ ID NO: 1127 - DNA, 11 bp, Zea mays
ggccccccgca

SEQ ID NO: 1128 - DNA, 11 bp, Zea mays
ggccccccgca

SEQ ID NO: 1129 - DNA, 11 bp, Zea mays
ggccccccgca

SEQ ID NO: 1130 - DNA, 11 bp, Zea mays
ggccccccgca

SEQ ID NO: 1131 - DNA, 11 bp, Zea mays
ggccccccgca

SEQ ID NO: 1132 - DNA, 11 bp, Zea mays
ggccccccgca

SEQ ID NO: 1133 - DNA, 11 bp, Zea mays
ggccccccgca

SEQ ID NO: 1134 - DNA, 11 bp, Zea mays
ggccccccgca

SEQ ID NO: 1135 - DNA, 11 bp, Zea mays
ggccccccgca

SEQ ID NO: 1136 - DNA, 11 bp, Zea mays
ggccccccgca

SEQ ID NO: 1137 - DNA, 11 bp, Zea mays
ggccccccgca

SEQ ID NO: 1138 - DNA, 11 bp, Zea mays
ggccccccgca

SEQ ID NO: 1139 - DNA, 11 bp, Zea mays
ggccccccgca

SEQ ID NO: 1140 - DNA, 11 bp, Zea mays
ggccccccgca

SEQ ID NO: 1141 - DNA, 11 bp, Zea mays
ggccccccgca

SEQ ID NO: 1142 - DNA, 11 bp, Zea mays
ggccccccgca

SEQ ID NO: 1143 - DNA, 11 bp, Zea mays
ggccccccgca

SEQ ID NO: 1144 - DNA, 11 bp, Zea mays
ggccccccgca

SEQ ID NO: 1145 - DNA, 11 bp, Zea mays
ggccccccgca

SEQ ID NO: 1146 - DNA, 11 bp, Zea mays
agccccccgca

SEQ ID NO: 1147 - DNA, 11 bp, Zea mays
agccccccgca

SEQ ID NO: 1148 - DNA, 11 bp, Zea mays
agccccccgca

SEQ ID NO: 1149 - DNA, 11 bp, Zea mays
agccccccgca

SEQ ID NO: 1150 - DNA, 11 bp, Zea mays
agccccccgca

SEQ ID NO: 1151 - DNA, 12 bp, Zea mays
ccgccccccgca

SEQ ID NO: 1152 - DNA, 11 bp, Zea mays
gcccccccgca

SEQ ID NO: 1153 - DNA, 11 bp, Gossypium hirsutum
ggccccccgca

SEQ ID NO: 1154 - DNA, 11 bp, Gossypium hirsutum
ggccccccaca

SEQ ID NO: 1155 - DNA, 11 bp, Gossypium hirsutum
ggccccccgca

SEQ ID NO: 1156 - DNA, 11 bp, Gossypium hirsutum
ggccccccgca

SEQ ID NO: 1157 - DNA, 11 bp, Gossypium hirsutum
ggccccccgca

SEQ ID NO: 1158 - DNA, 13 bp, Gossypium hirsutum
acgcccccccgca

SEQ ID NO: 1159 - DNA, 11 bp, Gossypium hirsutum
ggccccccgca

SEQ ID NO: 1160 - DNA, 11 bp, Gossypium hirsutum
ggccccccgca

SEQ ID NO: 1161 - DNA, 11 bp, Gossypium hirsutum
ggccccccgca

SEQ ID NO: 1162 - DNA, 11 bp, Gossypium hirsutum
ggccccccgca

SEQ ID NO: 1163 - DNA, 11 bp, Gossypium hirsutum
ggccccccgca

SEQ ID NO: 1164 - DNA, 11 bp, Gossypium hirsutum
ggccccccgca

SEQ ID NO: 1165 - DNA, 11 bp, Gossypium hirsutum
ggccccccgca

SEQ ID NO: 1166 - DNA, 11 bp, Gossypium hirsutum
ggccccccgca

SEQ ID NO: 1167 - DNA, 13 bp, Gossypium hirsutum
acgcccccccgca

SEQ ID NO: 1168 - DNA, 11 bp, Arabidopsis thaliana
ggccccccgca

SEQ ID NO: 1169 - DNA, 11 bp, Arabidopsis thaliana
ggccccccgca

SEQ ID NO: 1170 - DNA, 11 bp, Arabidopsis thaliana
ggccccccgca

SEQ ID NO: 1171 - DNA, 12 bp, Arabidopsis thaliana
ccgccccccgca

SEQ ID NO: 1172 - DNA, 11 bp, Arabidopsis thaliana
ggccccccgca

SEQ ID NO: 1173 - DNA, 11 bp, Arabidopsis thaliana
ggccccccgca

SEQ ID NO: 1174 - DNA, 11 bp, Arabidopsis thaliana
ggccccccgca

SEQ ID NO: 1175 - DNA, 11 bp, Arabidopsis thaliana
ggccccccgca

SEQ ID NO: 1176 - DNA, 11 bp, Arabidopsis thaliana
ggccccccgca

SEQ ID NO: 1177 - DNA, 11 bp, Arabidopsis thaliana
ggccccccgca

SEQ ID NO: 1178 - DNA, 11 bp, Arabidopsis thaliana
ggccccccgca

SEQ ID NO: 1179 - DNA, 11 bp, Arabidopsis thaliana
ggccccccgca

SEQ ID NO: 1180 - DNA, 11 bp, Arabidopsis thaliana
ggccccccgca

SEQ ID NO: 1181 - DNA, 11 bp, Arabidopsis thaliana
ggccccccgca

SEQ ID NO: 1182 - DNA, 11 bp, Arabidopsis thaliana
ggccccccgca

SEQ ID NO: 1183 - DNA, 11 bp, Arabidopsis thaliana
ggccccccgca

SEQ ID NO: 1184 - DNA, 11 bp, Arabidopsis thaliana
cgccccccgca

SEQ ID NO: 1185 - DNA, 11 bp, Arabidopsis thaliana
ggccccccgca

SEQ ID NO: 1186 - DNA, 11 bp, Arabidopsis thaliana
ggcaccccgca

SEQ ID NO: 1187 - DNA, 11 bp, Arabidopsis thaliana
ggccccccgca

SEQ ID NO: 1188 - DNA, 11 bp, Arabidopsis thaliana
ggccccccgca

SEQ ID NO: 1189 - DNA, 11 bp, Brassica napus
ggccccccgca

SEQ ID NO: 1190 - DNA, 11 bp, Brassica napus
  misc_feature (2)..(2): n is a, c, g, or t
gngcccccgca

SEQ ID NO: 1191 - DNA, 11 bp, Brassica napus
ggccccccgca

SEQ ID NO: 1192 - DNA, 11 bp, Brassica napus
ggccccccgca

SEQ ID NO: 1193 - DNA, 11 bp, Glycine max
ggccccccgca

SEQ ID NO: 1194 - DNA, 13 bp, Glycine max
ggacaccccgcca

SEQ ID NO: 1195 - DNA, 11 bp, Glycine max
ggccccccgca

SEQ ID NO: 1196 - DNA, 11 bp, Glycine max
ggccccccgca

SEQ ID NO: 1197 - DNA, 10 bp, Glycine max
gccccccgca

SEQ ID NO: 1198 - DNA, 11 bp, Glycine max
ggccccccgca

SEQ ID NO: 1199 - DNA, 11 bp, Glycine max
ggccccccgca

SEQ ID NO: 1200 - DNA, 11 bp, Glycine max
ggccccccgca

SEQ ID NO: 1201 - DNA, 11 bp, Glycine max
ggccccccgca

SEQ ID NO: 1202 - DNA, 11 bp, Glycine max
ggccccccgca

SEQ ID NO: 1203 - DNA, 11 bp, Glycine max
ggccccccgca

SEQ ID NO: 1204 - DNA, 11 bp, Glycine max
ggccccccgca

SEQ ID NO: 1205 - DNA, 11 bp, Glycine max
ggccccccgca

SEQ ID NO: 1206 - DNA, 11 bp, Glycine max
ggccccccgca

SEQ ID NO: 1207 - DNA, 12 bp, Glycine max
gcgccccccgca

SEQ ID NO: 1208 - DNA, 11 bp, Glycine max
ggccccccgca

SEQ ID NO: 1209 - DNA, 11 bp, Glycine max
ggccccccgca

SEQ ID NO: 1210 - DNA, 11 bp, Glycine max
ggcccaccgca

SEQ ID NO: 1211 - DNA, 11 bp, Glycine max
ggccccccgca

SEQ ID NO: 1212 - DNA, 11 bp, Glycine max
ggccccccgca

SEQ ID NO: 1213 - DNA, 11 bp, Glycine max
ggccccccgca

SEQ ID NO: 1214 - DNA, 12 bp, Medicago truncatula
aagccccccgca

SEQ ID NO: 1215 - DNA, 11 bp, Medicago truncatula
ggcccaccgca

SEQ ID NO: 1216 - DNA, 11 bp, Medicago truncatula
ggccccccgca

SEQ ID NO: 1217 - DNA, 11 bp, Medicago truncatula
ggccccccgca

SEQ ID NO: 1218 - DNA, 11 bp, Medicago truncatula
ggccccccgca

SEQ ID NO: 1219 - DNA, 11 bp, Hordeum vulgare
ggccccccgca

SEQ ID NO: 1220 - DNA, 11 bp, Hordeum vulgare
ggccccccgca

SEQ ID NO: 1221 - DNA, 11 bp, Hordeum vulgare
agccccccgca

SEQ ID NO: 1222 - DNA, 11 bp, Hordeum vulgare
ggccccccgca

SEQ ID NO: 1223 - DNA, 11 bp, Oryza sativa
ggccccccgca

SEQ ID NO: 1224 - DNA, 11 bp, Oryza sativa
ggccccccgca

SEQ ID NO: 1225 - DNA, 11 bp, Oryza sativa
ggccccccgca

SEQ ID NO: 1226 - DNA, 11 bp, Oryza sativa
ggccccccgca

SEQ ID NO: 1227 - DNA, 11 bp, Oryza sativa
ggccccccgca

SEQ ID NO: 1228 - DNA, 11 bp, Oryza sativa
agccccccgca

SEQ ID NO: 1229 - DNA, 13 bp, Oryza sativa
gagccaccccgca

SEQ ID NO: 1230 - DNA, 11 bp, Oryza sativa
ggccccccgca

SEQ ID NO: 1231 - DNA, 11 bp, Oryza sativa
ggccccccgca

SEQ ID NO: 1232 - DNA, 11 bp, Oryza sativa
ggccccccgca

SEQ ID NO: 1233 - DNA, 11 bp, Oryza sativa
ggccccccgca

SEQ ID NO: 1234 - DNA, 11 bp, Oryza sativa
ggccccccgca

SEQ ID NO: 1235 - DNA, 11 bp, Oryza sativa
agccccccgca

SEQ ID NO: 1236 - DNA, 11 bp, Oryza sativa
ggccccccgca

SEQ ID NO: 1237 - DNA, 11 bp, Oryza sativa
ggccccccgca

SEQ ID NO: 1238 - DNA, 11 bp, Oryza sativa
ggccccccgca

SEQ ID NO: 1239 - DNA, 11 bp, Sorghum bicolor
ggccccccgca

SEQ ID NO: 1240 - DNA, 11 bp, Sorghum bicolor
ggccccccgca

SEQ ID NO: 1241 - DNA, 11 bp, Sorghum bicolor
agccccccgca

SEQ ID NO: 1242 - DNA, 11 bp, Sorghum bicolor
ggccccccgca

SEQ ID NO: 1243 - DNA, 11 bp, Triticum aestivum
ggccccccgca

SEQ ID NO: 1244 - DNA, 11 bp, Triticum aestivum
ggccccccgca

SEQ ID NO: 1245 - DNA, 11 bp, Triticum aestivum
agccccccgca

SEQ ID NO: 1246 - DNA, 11 bp, Triticum aestivum
ggccccccgca

SEQ ID NO: 1247 - DNA, 11 bp, Triticum aestivum
ggccccccgca

SEQ ID NO: 1248 - DNA, 24 bp, Zea mays
tggcatacaggctagagccaggca

SEQ ID NO: 1249 - DNA, 20 bp, Zea mays
aggcaacagggagccaggca

SEQ ID NO: 1250 - DNA, 20 bp, Zea mays
aggcaacagggagccaggca

SEQ ID NO: 1251 - DNA, 20 bp, Zea mays
aggcaacagggagccaggca

SEQ ID NO: 1252 - DNA, 20 bp, Zea mays
aggcaacagggagccaggca

SEQ ID NO: 1253 - DNA, 20 bp, Zea mays
agccaacagggagccaggca

SEQ ID NO: 1254 - DNA, 21 bp, Zea mays
aggcaacagggagcccaggca

SEQ ID NO: 1255 - DNA, 21 bp, Zea mays
tggagaagcagggcacgtgca

SEQ ID NO: 1256 - DNA, 640 bp, Zea mays; identical to SEQ ID NO: 1117

SEQ ID NO: 1257 - DNA, 639 bp, Artificial sequence
  Synthetic construct
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaaggagcacggcccgtatgcttctccaattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 1258 - DNA, 15 bp, Gossypium hirsutum
gaacggcccgcccca

SEQ ID NO: 1259 - DNA, 14 bp, Gossypium hirsutum
agcacggccgccca

SEQ ID NO: 1260 - DNA, 13 bp, Arabidopsis thaliana
acggcccgcccca

SEQ ID NO: 1261 - DNA, 14 bp, Arabidopsis thaliana
agcacggccgccca

SEQ ID NO: 1262 - DNA, 16 bp, Arabidopsis thaliana
agcacgacccgcccca

SEQ ID NO: 1263 - DNA, 16 bp, Arabidopsis thaliana
agcacgacccgcccca

SEQ ID NO: 1264 - DNA, 13 bp, Arabidopsis thaliana
acggcccgcccca

SEQ ID NO: 1265 - DNA, 15 bp, Arabidopsis thaliana
ccacggaccgccccg

SEQ ID NO: 1266 - DNA, 14 bp, Arabidopsis thaliana
agcacggccgccca

SEQ ID NO: 1267 - DNA, 14 bp, Arabidopsis thaliana
cacggcccgcccca

SEQ ID NO: 1268 - DNA, 14 bp, Brassica napus
agcacggccgccca

SEQ ID NO: 1269 - DNA, 13 bp, Brassica napus
acggcccgcccca

SEQ ID NO: 1270 - DNA, 13 bp, Brassica oleracea
acggcccgcccca

SEQ ID NO: 1271 - DNA, 14 bp, Glycine max
agcacggccgccca

SEQ ID NO: 1272 - DNA, 14 bp, Glycine max
cacggcccgcccca

SEQ ID NO: 1273 - DNA, 14 bp, Glycine max
cacggcccgcccca

SEQ ID NO: 1274 - DNA, 16 bp, Glycine max
agcaaggcccgcccca

SEQ ID NO: 1275 - DNA, 16 bp, Glycine max
agcaaggcccgcccca

SEQ ID NO: 1276 - DNA, 14 bp, Glycine max
cacggcccgcccca

SEQ ID NO: 1277 - DNA, 14 bp, Glycine max
cacggcccgcccca

SEQ ID NO: 1278 - DNA, 16 bp, Medicago truncatula
agcaaggcccgcccca

SEQ ID NO: 1279 - DNA, 14 bp, Medicago truncatula
agcacggccgccca

SEQ ID NO: 1280 - DNA, 13 bp, Medicago truncatula
cacggccgcccca

SEQ ID NO: 1281 - DNA, 16 bp, Hordeum vulgare
cgcacggaccgcccca

SEQ ID NO: 1282 - DNA, 16 bp, Hordeum vulgare
cgcacggaccgcccca

SEQ ID NO: 1283 - DNA, 16 bp, Hordeum vulgare
agcaaggcccgcccca

SEQ ID NO: 1284 - DNA, 16 bp, Hordeum vulgare
agcaaggcccgcccca

SEQ ID NO: 1285 - DNA, 16 bp, Oryza sativa
cgcacggaccgcccca

SEQ ID NO: 1286 - DNA, 16 bp, Oryza sativa
agcaaggcccgcccca

SEQ ID NO: 1287 - DNA, 16 bp, Oryza sativa
cgcacggaccgcccca

SEQ ID NO: 1288 - DNA, 16 bp, Oryza sativa
agcaaggcccgcccca

SEQ ID NO: 1289 - DNA, 15 bp, Oryza sativa
agcaaggccgccccg

SEQ ID NO: 1290 - DNA, 14 bp, Oryza sativa
agcaaggccgcccg

SEQ ID NO: 1291 - DNA, 16 bp, Oryza sativa
cgcacggaccgcccca

SEQ ID NO: 1292 - DNA, 16 bp, Sorghum bicolor
cacacggaccgccccg

SEQ ID NO: 1293 - DNA, 16 bp, Sorghum bicolor
agcagggcccgcccca

SEQ ID NO: 1294 - DNA, 16 bp, Sorghum bicolor
cacacggaccgcccca

SEQ ID NO: 1295 - DNA, 16 bp, Sorghum bicolor
cacacggaccgcccca

SEQ ID NO: 1296 - DNA, 16 bp, Sorghum bicolor
agcaaggcccgcccca

SEQ ID NO: 1297 - DNA, 15 bp, Sorghum bicolor
agcagggccgccccg

SEQ ID NO: 1298 - DNA, 16 bp, Triticum aestivum
cgcacggaccgccccc

SEQ ID NO: 1299 - DNA, 16 bp, Triticum aestivum
agcaaggcccgcccca

SEQ ID NO: 1300 - DNA, 17 bp, Triticum aestivum
cgcacgcgcccgccgca

SEQ ID NO: 1301 - DNA, 15 bp, Triticum aestivum
agcaaggccgccccg

SEQ ID NO: 1302 - DNA, 15 bp, Triticum aestivum
agcaaggccgccccg

SEQ ID NO: 1303 - DNA, 16 bp, Triticum aestivum
agcaaggcccgcccca

SEQ ID NO: 1304 - DNA, 15 bp, Triticum aestivum
agcaaggccgccccg

SEQ ID NO: 1305 - DNA, 16 bp, Zea mays
cacacggaccgccccg

SEQ ID NO: 1306 - DNA, 14 bp, Zea mays
agggggccgcccca

SEQ ID NO: 1307 - DNA, 15 bp, Zea mays
agccggcccgcccca

SEQ ID NO: 1308 - DNA, 15 bp, Zea mays
agccggcccgcccca

SEQ ID NO: 1309 - DNA, 16 bp, Zea mays
agcaaggcccgcccca

SEQ ID NO: 1310 - DNA, 16 bp, Zea mays
agcagggcccgcccca

SEQ ID NO: 1311 - DNA, 21 bp, Zea mays
tcggaccaggcttcattcccc

SEQ ID NO: 1312 - DNA, 640 bp, Zea mays; identical to SEQ ID NO: 1117

SEQ ID NO: 1313 - DNA, 640 bp, Artificial sequence
  Synthetic construct
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaaggcgggaatgaagctacctggtccgaattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 1314 - DNA, 640 bp, Artificial sequence; identical to SEQ ID NO: 1313
  Synthetic construct

SEQ ID NO: 1315 - DNA, 17 bp, Gossypium hirsutum
cgggagaagccggccgg

SEQ ID NO: 1316 - DNA, 17 bp, Gossypium hirsutum
cgggagaagccggccgg

SEQ ID NO: 1317 - DNA, 17 bp, Arabidopsis thaliana
cgggagaagccggccgg

SEQ ID NO: 1318 - DNA, 16 bp, Arabidopsis thaliana
gggagaagccggccgg

SEQ ID NO: 1319 - DNA, 17 bp, Arabidopsis thaliana
cggaagaagccggccgg

SEQ ID NO: 1320 - DNA, 16 bp, Arabidopsis thaliana
gggagaagccggccgg

SEQ ID NO: 1321 - DNA, 17 bp, Arabidopsis thaliana
cgggagaagccggccgg

SEQ ID NO: 1322 - DNA, 17 bp, Arabidopsis thaliana
cgggagaagccggccgg

SEQ ID NO: 1323 - DNA, 17 bp, Brassica napus
cggaagaagccggccgg

SEQ ID NO: 1324 - DNA, 16 bp, Brassica napus
gggagaagccggccgg

SEQ ID NO: 1325 - DNA, 16 bp, Brassica oleracea
gggagaagccggccgg

SEQ ID NO: 1326 - DNA, 17 bp, Glycine max
cggaagaagccggccgg

SEQ ID NO: 1327 - DNA, 17 bp, Glycine max
cggaagaagccggccgg

SEQ ID NO: 1328 - DNA, 17 bp, Glycine max
cgggagaagccggccgg

SEQ ID NO: 1329 - DNA, 17 bp, Glycine max
cgggagaagccggccgg

SEQ ID NO: 1330 - DNA, 17 bp, Glycine max
cgggagaagccggccgg

SEQ ID NO: 1331 - DNA, 16 bp, Glycine max
gggagaagccggccgg

SEQ ID NO: 1332 - DNA, 16 bp, Glycine max
gggagaagccggccgg

SEQ ID NO: 1333 - DNA, 17 bp, Glycine max
cggaagaagccggccgg

SEQ ID NO: 1334 - DNA, 18 bp, Medicago truncatula
ccgggagaagccggccgg

SEQ ID NO: 1335 - DNA, 17 bp, Medicago truncatula
cgggagaagccggccgg

SEQ ID NO: 1336 - DNA, 17 bp, Medicago truncatula
cggaagaagccggccgg

SEQ ID NO: 1337 - DNA, 17 bp, Medicago truncatula
cggaagaagccggccgg

SEQ ID NO: 1338 - DNA, 17 bp, Oryza sativa
cgggagaagccggccgg

SEQ ID NO: 1339 - DNA, 16 bp, Oryza sativa
gggagaagccggccgg

SEQ ID NO: 1340 - DNA, 17 bp, Oryza sativa
cgggagaagccggccgg

SEQ ID NO: 1341 - DNA, 17 bp, Oryza sativa
cgggagaagccggccgg

SEQ ID NO: 1342 - DNA, 16 bp, Oryza sativa
gggagaagccggccgg

SEQ ID NO: 1343 - DNA, 16 bp, Sorghum bicolor
gggagaagccggccgg

SEQ ID NO: 1344 - DNA, 16 bp, Triticum aestivum
gggagaagccggccgg

SEQ ID NO: 1345 - DNA, 17 bp, Triticum aestivum
gggaagaagccggccgg

SEQ ID NO: 1346 - DNA, 16 bp, Triticum aestivum
cgggagagccggccga

SEQ ID NO: 1347 - DNA, 18 bp, Zea mays
ccgggagaagccggccgg

SEQ ID NO: 1348 - DNA, 16 bp, Zea mays
gggagaagccggccgg

SEQ ID NO: 1349 - DNA, 17 bp, Zea mays
cgggagaagccggccgg

SEQ ID NO: 1350 - DNA, 17 bp, Zea mays
cgggagaagccggccgg

SEQ ID NO: 1351 - DNA, 16 bp, Zea mays
gggagaagccggccgg

SEQ ID NO: 1352 - DNA, 17 bp, Zea mays
cgggagaagccggccgg

SEQ ID NO: 1353 - DNA, 17 bp, Zea mays
cgggagaagccggccgg

SEQ ID NO: 1354 - DNA, 17 bp, Zea mays
cgggagaagccggccgg

SEQ ID NO: 1355 - DNA, 16 bp, Zea mays
gggagaagccggccgg

SEQ ID NO: 1356 - DNA, 17 bp, Zea mays
cgggagaagccggccgg

SEQ ID NO: 1357 - DNA, 16 bp, Zea mays
gggagaagccggccgg

SEQ ID NO: 1358 - DNA, 17 bp, Zea mays
cgggagaagccggccgg

SEQ ID NO: 1359 - DNA, 16 bp, Zea mays
gggagaagccggccgg

SEQ ID NO: 1360 - DNA, 16 bp, Zea mays
gggagaagccggccgg

SEQ ID NO: 1361 - DNA, 21 bp, Zea mays
tgaagctgccagcatgatcta

SEQ ID NO: 1362 - DNA, 21 bp, Zea mays
tgaagctgccagcatgatctg

SEQ ID NO: 1363 - DNA, 640 bp, Zea mays; identical to SEQ ID NO: 1117

SEQ ID NO: 1364 - DNA, 640 bp, Artificial sequence
  Synthetic construct
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaagggagatcatgctctaggcagcttcaattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 1365 - DNA, 15 bp, Arabidopsis thaliana
agacaggcggcagcg

SEQ ID NO: 1366 - DNA, 15 bp, Brassica napus
agacaggcggcagcg

SEQ ID NO: 1367 - DNA, 15 bp, Glycine max
agacaggcggcagcg

SEQ ID NO: 1368 - DNA, 15 bp, Glycine max
agacaggcggcagcg

SEQ ID NO: 1369 - DNA, 15 bp, Glycine max
agacaggcggcagcg

SEQ ID NO: 1370 - DNA, 15 bp, Medicago truncatula
agacaggcggcagcg

SEQ ID NO: 1371 - DNA, 15 bp, Medicago truncatula
agacaggcggcagcg

SEQ ID NO: 1372 - DNA, 15 bp, Hordeum vulgare
agacaggcggcagcg

SEQ ID NO: 1373 - DNA, 15 bp, Oryza sativa
agacaggcggcagcg

SEQ ID NO: 1374 - DNA, 15 bp, Oryza sativa
agacaggcggcagcg

SEQ ID NO: 1375 - DNA, 15 bp, Sorghum bicolor
agacaggcggcagcg

SEQ ID NO: 1376 - DNA, 15 bp, Zea mays
agacaggcggcagcg

SEQ ID NO: 1377 - DNA, 15 bp, Zea mays
agacaggcggcagcg

SEQ ID NO: 1378 - DNA, 15 bp, Zea mays
agacaggcggcagcg

SEQ ID NO: 1379 - DNA, 15 bp, Zea mays
agacaggcggcagcg

SEQ ID NO: 1380 - DNA, 15 bp, Zea mays
agacaggcggcagcg

SEQ ID NO: 1381 - DNA, 15 bp, Zea mays
agacaggcggcagcg

SEQ ID NO: 1382 - DNA, 15 bp, Zea mays
agacaggcggcagcg

SEQ ID NO: 1383 - DNA, 15 bp, Zea mays
agacaggcggcagcg

SEQ ID NO: 1384 - DNA, 21 bp, Zea mays
tagccaaggatgacttgcctg

SEQ ID NO: 1385 - DNA, 21 bp, Zea mays
cagccaaggatgacttgccga

SEQ ID NO: 1386 - DNA, 640 bp, Zea mays; identical to SEQ ID NO: 1117

SEQ ID NO: 1387 - DNA, 640 bp, Artificial sequence
  Synthetic construct
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaaggaggcaagtcatgtaccttggctcaattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 1388 - DNA, 13 bp, Gossypium hirsutum
caggcaacacggc

SEQ ID NO: 1389 - DNA, 14 bp, Gossypium hirsutum
cggcaaccaccggc

SEQ ID NO: 1390 - DNA, 14 bp, Gossypium hirsutum
aggcaaacacggcc

SEQ ID NO: 1391 - DNA, 15 bp, Gossypium hirsutum
ggggaagcaccggcc

SEQ ID NO: 1392 - DNA, 13 bp, Gossypium hirsutum
caggcaacacggc

SEQ ID NO: 1393 - DNA, 14 bp, Gossypium hirsutum
caggcaaacacggc

SEQ ID NO: 1394 - DNA, 15 bp, Gossypium hirsutum
ccggcaaccaccggc

SEQ ID NO: 1395 - DNA, 15 bp, Arabidopsis thaliana
caggcaaacacggcc

SEQ ID NO: 1396 - DNA, 14 bp, Arabidopsis thaliana
ccggcaaacacggc

SEQ ID NO: 1397 - DNA, 14 bp, Arabidopsis thaliana
ccggcaaacacggc

SEQ ID NO: 1398 - DNA, 16 bp, Arabidopsis thaliana
aagggaagcaccggcg

SEQ ID NO: 1399 - DNA, 16 bp, Arabidopsis thaliana
aggggaagcaccggca

SEQ ID NO: 1400 - DNA, 16 bp, Arabidopsis thaliana
aggggaagcaccggca

SEQ ID NO: 1401 - DNA, 14 bp, Arabidopsis thaliana
ccggcaaacacggc

SEQ ID NO: 1402 - DNA, 16 bp, Arabidopsis thaliana
aagggaagcaccggcg

SEQ ID NO: 1403 - DNA, 15 bp, Arabidopsis thaliana
caggcaaacacggcc

SEQ ID NO: 1404 - DNA, 14 bp, Arabidopsis thaliana
ccggcaaacacggc

SEQ ID NO: 1405 - DNA, 16 bp, Arabidopsis thaliana
acgggaagcaccggca

SEQ ID NO: 1406 - DNA, 16 bp, Arabidopsis thaliana
aggggaagcaccggca

SEQ ID NO: 1407 - DNA, 16 bp, Brassica napus
aggggaagcaacggca

SEQ ID NO: 1408 - DNA, 13 bp, Brassica napus
cggcaaccacggc

SEQ ID NO: 1409 - DNA, 14 bp, Brassica napus
cggcaaacacggcc

SEQ ID NO: 1410 - DNA, 14 bp, Brassica napus
gaggcaaccacggc

SEQ ID NO: 1411 - DNA, 16 bp, Brassica rapa
aggggaagcaccggca

SEQ ID NO: 1412 - DNA, 16 bp, Brassica oleracea
aggggaagcaccggca

SEQ ID NO: 1413 - DNA, 14 bp, Glycine max
cggcaaccacggcc

SEQ ID NO: 1414 - DNA, 15 bp, Glycine max
aggcaaccaccggcc

SEQ ID NO: 1415 - DNA, 15 bp, Glycine max
aggcaaccaccggcc

SEQ ID NO: 1416 - DNA, 14 bp, Glycine max
cggcaaacaccggc

SEQ ID NO: 1417 - DNA, 15 bp, Glycine max
aaggcaaccaccggc

SEQ ID NO: 1418 - DNA, 15 bp, Glycine max
gcggcaaacacggcg

SEQ ID NO: 1419 - DNA, 15 bp, Glycine max
gcggcaaacacggcg

SEQ ID NO: 1420 - DNA, 14 bp, Glycine max
cggcaaacaccggc

SEQ ID NO: 1421 - DNA, 14 bp, Glycine max
cggcaaacaccggc

SEQ ID NO: 1422 - DNA, 15 bp, Glycine max
aaggcaaccaccggc

SEQ ID NO: 1423 - DNA, 14 bp, Medicago truncatula
caggcaaccacggc

SEQ ID NO: 1424 - DNA, 15 bp, Medicago truncatula
aggcaaccaccggcc

SEQ ID NO: 1425 - DNA, 15 bp, Medicago truncatula
aaggcaaacaccggc

SEQ ID NO: 1426 - DNA, 16 bp, Medicago truncatula
ccggcaggcaccggca

SEQ ID NO: 1427 - DNA, 16 bp, Medicago truncatula
ccggcaggcaccggca

SEQ ID NO: 1428 - DNA, 14 bp, Medicago truncatula
ccggcaaacacggc

SEQ ID NO: 1429 - DNA, 16 bp, Medicago truncatula
ccggcaagcaccggcc

SEQ ID NO: 1430 - DNA, 13 bp, Hordeum vulgare
gggcaacacggcc

SEQ ID NO: 1431 - DNA, 14 bp, Hordeum vulgare
cggcaaacaccggc

SEQ ID NO: 1432 - DNA, 13 bp, Hordeum vulgare
caggcaacacggc

SEQ ID NO: 1433 - DNA, 14 bp, Oryza sativa
aggcaaacacggcc

SEQ ID NO: 1434 - DNA, 14 bp, Oryza sativa
gggcaacaccggcg

SEQ ID NO: 1435 - DNA, 12 bp, Oryza sativa
caggcaacaggc

SEQ ID NO: 1436 - DNA, 16 bp, Oryza sativa
ccggcaagcaccggcg

SEQ ID NO: 1437 - DNA, 14 bp, Oryza sativa
aggcaaacaccggc

SEQ ID NO: 1438 - DNA, 16 bp, Oryza sativa
ccggcaagcaccggcg

SEQ ID NO: 1439 - DNA, 13 bp, Oryza sativa
aggcaacaccggc

SEQ ID NO: 1440 - DNA, 13 bp, Oryza sativa
caggcaacacggc

SEQ ID NO: 1441 - DNA, 13 bp, Oryza sativa
gggcaacaccggc

SEQ ID NO: 1442 - DNA, 13 bp, Oryza sativa
caggcaacacggc

SEQ ID NO: 1443 - DNA, 13 bp, Oryza sativa
gggcaacaccggc

SEQ ID NO: 1444 - DNA, 13 bp, Sorghum bicolor
caggcaacacggc

SEQ ID NO: 1445 - DNA, 14 bp, Sorghum bicolor
aggcaaacacggcg

SEQ ID NO: 1446 - DNA, 14 bp, Sorghum bicolor
cggcaaccaccggc

SEQ ID NO: 1447 - DNA, 14 bp, Sorghum bicolor
aggcaaacacggcg

SEQ ID NO: 1448 - DNA, 14 bp, Triticum aestivum
cggcaaccaccggc

SEQ ID NO: 1449 - DNA, 13 bp, Triticum aestivum
caggcaacacggc

SEQ ID NO: 1450 - DNA, 15 bp, Triticum aestivum
caggcaaccaccggc

SEQ ID NO: 1451 - DNA, 15 bp, Triticum aestivum
caggcaaacacggcc

SEQ ID NO: 1452 - DNA, 15 bp, Triticum aestivum
ccggcaaacaccggc

SEQ ID NO: 1453 - DNA, 15 bp, Triticum aestivum
caggcaaacacggcc

SEQ ID NO: 1454 - DNA, 14 bp, Triticum aestivum
cggcaaacaccggc

SEQ ID NO: 1455 - DNA, 14 bp, Triticum aestivum
cggcaaacaccggc

SEQ ID NO: 1456 - DNA, 13 bp, Triticum aestivum
gggcaacaccggc

SEQ ID NO: 1457 - DNA, 13 bp, Triticum aestivum
gggcaacaccggc

SEQ ID NO: 1458 - DNA, 16 bp, Zea mays
ccggcaagcaccggcg

SEQ ID NO: 1459 - DNA, 14 bp, Zea mays
gggcaaccaccggc

SEQ ID NO: 1460 - DNA, 14 bp, Zea mays
cggcaaccaccggc

SEQ ID NO: 1461 - DNA, 14 bp, Zea mays
caggcaacaccggc

SEQ ID NO: 1462 - DNA, 13 bp, Zea mays
gggcaacaccggc

SEQ ID NO: 1463 - DNA, 13 bp, Zea mays
caggcaacacggc

SEQ ID NO: 1464 - DNA, 15 bp, Zea mays
gggcaaccaccggcc

SEQ ID NO: 1465 - DNA, 14 bp, Zea mays
aggcaaacacggcg

SEQ ID NO: 1466 - DNA, 13 bp, Zea mays
caggcaacacggc

SEQ ID NO: 1467 - DNA, 14 bp, Zea mays
cggcaaccaccggc

SEQ ID NO: 1468 - DNA, 14 bp, Zea mays
cggcaaccaccggc

SEQ ID NO: 1469 - DNA, 14 bp, Zea mays
cggcaaccaccggc

SEQ ID NO: 1470 - DNA, 13 bp, Zea mays
aggcaaacaggcg

SEQ ID NO: 1471 - DNA, 14 bp, Zea mays
aggcaaacacggcg

SEQ ID NO: 1472 - DNA, 14 bp, Zea mays
aggcaaacacggcg

SEQ ID NO: 1473 - DNA, 12 bp, Zea mays
caggcaacaggc

SEQ ID NO: 1474 - DNA, 13 bp, Zea mays
caggcaacacggc

SEQ ID NO: 1475 - DNA, 14 bp, Zea mays
cggcaaccaccggc

SEQ ID NO: 1476 - DNA, 14 bp, Zea mays
cggcaaccaccggc

SEQ ID NO: 1477 - DNA, 21 bp, Zea mays
tgattgagccgtgccaatatc

SEQ ID NO: 1478 - DNA, 403 bp, Oryza sativa
ctagatcttcatgatatatagctcttttgtttgttcttggtgtccatgttcgagggagggtgccagtcgttgcaacattgcagttatgtattttgtgtttttttttaattttattttggtgatattaaggttggtccattagacggccttgcgacgacgggatattggggcggttcaatcagaaagcttgtgctccagaagcgaggagctctactcttttgattgagccgtgccaatatcacgtcgcatccatcactttggatgtttctttcatgcaggtggtcttgattcccttgtttttcgccagcattgtaggtttatttgttactttatttctgtgtttagctacgattagtgataatctggatttgtatatatatatatatatatatatatatacagt

SEQ ID NO: 1479 - DNA, 16 bp, Zea mays
gaaggcgcggccaaca

SEQ ID NO: 1480 - DNA, 16 bp, Zea mays
gaaggcgcggccaaca

SEQ ID NO: 1481 - DNA, 16 bp, Zea mays
gaaggcgcggccaaca

SEQ ID NO: 1482 - DNA, 16 bp, Zea mays
gaaggcgcggccaaca

SEQ ID NO: 1483 - DNA, 16 bp, Zea mays
gaaggcgcggccaaca

SEQ ID NO: 1484 - DNA, 15 bp, Zea mays
gaagggcggccaaca

SEQ ID NO: 1485 - DNA, 15 bp, Zea mays
gaaggcgcggccaaa

SEQ ID NO: 1486 - DNA, 21 bp, Zea mays
agaatcttgatgatgctgcat

SEQ ID NO: 1487 - DNA, 21 bp, Zea mays
ggaatcttgatgatgctgcat

SEQ ID NO: 1488 - DNA, 640 bp, Zea mays; identical to SEQ ID NO: 1117

SEQ ID NO: 1489 - DNA, 639 bp, Artificial sequence
  Synthetic construct
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaaggggcagcatcactatcaagattctattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 1490 - DNA, 640 bp, Artificial sequence
  Synthetic construct
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaaggttgcagcatcactatcaagattccattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 1491 - DNA, 640 bp, Artificial sequence
  Synthetic construct
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaaggctgcagcatcactatcaagattctattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 1492 - DNA, 17 bp, Zea mays
agagaccacagcaaaca

SEQ ID NO: 1493 - DNA, 337 bp, Artificial sequence
  Synthetic construct
aattcattacattgataaaacacaattcaaaagatcaatgttccacttcatgcaaagacatttccaaaatatgtgtaggtagaggggttttacaggatcgtccatgatgctggtgagtggtgccccacatgatgcagctatgtttgctatggcaccactcacaagaatcatggtcgcccttgttggactgtccaactcctactgattgcggatgcacttgccacaaatgaaaatcaaagcgaggggaaaagaatgtagagtgtgactacgattgcatgcatgtgatttaggtaattaagttacatgattgtctaattgtgtttatggaattgtatat

SEQ ID NO: 1494 - DNA, 16 bp, Gossypium hirsutum
cgcagcacacaggacc

SEQ ID NO: 1495 - DNA, 16 bp, Gossypium hirsutum
cgcagcacacaggacc

SEQ ID NO: 1496 - DNA, 16 bp, Gossypium hirsutum
cgcagcacacaggacc

SEQ ID NO: 1497 - DNA, 15 bp, Gossypium hirsutum
cgcagcacacaggac

SEQ ID NO: 1498 - DNA, 15 bp, Gossypium hirsutum
agcagcacacaggac

SEQ ID NO: 1499 - DNA, 15 bp, Gossypium hirsutum
cgcagcacacaggac

SEQ ID NO: 1500 - DNA, 14 bp, Arabidopsis thaliana
gagcacacaggacc

SEQ ID NO: 1501 - DNA, 16 bp, Arabidopsis thaliana
cagcagcacacaggac

SEQ ID NO: 1502 - DNA, 15 bp, Arabidopsis thaliana
gcagcacacaggacc

SEQ ID NO: 1503 - DNA, 15 bp, Arabidopsis thaliana
agcagcacacaggac

SEQ ID NO: 1504 - DNA, 14 bp, Arabidopsis thaliana
gagcacacaggacc

SEQ ID NO: 1505 - DNA, 15 bp, Arabidopsis thaliana
cgcagcacacaggac

SEQ ID NO: 1506 - DNA, 16 bp, Arabidopsis thaliana
cagcagcacacaggac

SEQ ID NO: 1507 - DNA, 15 bp, Arabidopsis thaliana
ggcagcacacaggac

SEQ ID NO: 1508 - DNA, 15 bp, Arabidopsis thaliana
cgcagcacacaggac

SEQ ID NO: 1509 - DNA, 14 bp, Arabidopsis thaliana
gagcacacaggacc

SEQ ID NO: 1510 - DNA, 15 bp, Arabidopsis thaliana
agcagcacacaggac

SEQ ID NO: 1511 - DNA, 15 bp, Brassica napus
cgcagcacacaggac

SEQ ID NO: 1512 - DNA, 15 bp, Brassica napus
cgcagcacacaggac

SEQ ID NO: 1513 - DNA, 15 bp, Brassica rapa
cgcagcacacaggac

SEQ ID NO: 1514 - DNA, 16 bp, Glycine max
cgcagcacacaggacc

SEQ ID NO: 1515 - DNA, 15 bp, Glycine max
cgcagcacacaggac

SEQ ID NO: 1516 - DNA, 15 bp, Glycine max
cgcagcacacaggac

SEQ ID NO: 1517 - DNA, 15 bp, Glycine max
cgcagcacacaagcc

SEQ ID NO: 1518 - DNA, 15 bp, Glycine max
cgcagcacacaggac

SEQ ID NO: 1519 - DNA, 15 bp, Glycine max
cgcagcacacaggac

SEQ ID NO: 1520 - DNA, 16 bp, Glycine max
agcagcacacaggacg

SEQ ID NO: 1521 - DNA, 14 bp, Glycine max
cgcagcacacagga

SEQ ID NO: 1522 - DNA, 15 bp, Glycine max
cgcagcacacaggac

SEQ ID NO: 1523 - DNA, 15 bp, Glycine max
cgcagcacacaggac

SEQ ID NO: 1524 - DNA, 15 bp, Glycine max
cgcagcacacaggac

SEQ ID NO: 1525 - DNA, 16 bp, Glycine max
cgcagcacacaggacc

SEQ ID NO: 1526 - DNA, 15 bp, Glycine max
cgcagcacacaagcc

SEQ ID NO: 1527 - DNA, 16 bp, Glycine max
cgcagcacacaggacc

SEQ ID NO: 1528 - DNA, 15 bp, Medicago truncatula
cgcagcacacaggac

SEQ ID NO: 1529 - DNA, 16 bp, Medicago truncatula
cgcagcacacaggacc

SEQ ID NO: 1530 - DNA, 16 bp, Medicago truncatula
cgcagcacacaggacc

SEQ ID NO: 1531 - DNA, 16 bp, Medicago truncatula
cgcagcacacaggacc

SEQ ID NO: 1532 - DNA, 16 bp, Medicago truncatula
cagcagcacacaggac

SEQ ID NO: 1533 - DNA, 15 bp, Hordeum vulgare
cgcagcacacaggac

SEQ ID NO: 1534 - DNA, 15 bp, Hordeum vulgare
cgcagcacacaggac

SEQ ID NO: 1535 - DNA, 16 bp, Oryza sativa
cgcagcacacacgacc

SEQ ID NO: 1536 - DNA, 15 bp, Oryza sativa
cgcagcacacaggac

SEQ ID NO: 1537 - DNA, 15 bp, Oryza sativa
cgcagcacacaggac

SEQ ID NO: 1538 - DNA, 16 bp, Oryza sativa
cgcagcacacacgacc

SEQ ID NO: 1539 - DNA, 15 bp, Oryza sativa
cgcagcacacaggac

SEQ ID NO: 1540 - DNA, 15 bp, Oryza sativa
cgcagcacacaggac

SEQ ID NO: 1541 - DNA, 16 bp, Oryza sativa
cgcagcacacaggacc

SEQ ID NO: 1542 - DNA, 15 bp, Oryza sativa
cgcagcacacaggac

SEQ ID NO: 1543 - DNA, 16 bp, Oryza sativa
cgcagcacacacgacc

SEQ ID NO: 1544 - DNA, 15 bp, Oryza sativa
cgcagcacacaggac

SEQ ID NO: 1545 - DNA, 15 bp, Oryza sativa
cgcagcacacaggac

SEQ ID NO: 1546 - DNA, 15 bp, Oryza sativa
cgcagcacacaggac

SEQ ID NO: 1547 - DNA, 16 bp, Oryza sativa
cgcagcacacaggacc

SEQ ID NO: 1548 - DNA, 15 bp, Sorghum bicolor
cgcagcacacaggac

SEQ ID NO: 1549 - DNA, 15 bp, Sorghum bicolor
cgcagcacacaggac

SEQ ID NO: 1550 - DNA, 15 bp, Triticum aestivum
cgcagcacacaggac

SEQ ID NO: 1551 - DNA, 15 bp, Triticum aestivum
cgcagcacacaggac

SEQ ID NO: 1552 - DNA, 14 bp, Triticum aestivum
cgcagcacacagga

SEQ ID NO: 1553 - DNA, 14 bp, Triticum aestivum
cgcagcacacagga

SEQ ID NO: 1554 - DNA, 14 bp, Triticum aestivum
cgcagcacacagga

SEQ ID NO: 1555 - DNA, 14 bp, Triticum aestivum
gcagcacacaggac

SEQ ID NO: 1556 - DNA, 17 bp, Triticum aestivum
cagcagcacacaggacc

SEQ ID NO: 1557 - DNA, 15 bp, Triticum aestivum
cgcagcacacaggac

SEQ ID NO: 1558 - DNA, 15 bp, Triticum aestivum
cgcagcacacaggac

SEQ ID NO: 1559 - DNA, 16 bp, Triticum aestivum
cgcagcacacacgacc

SEQ ID NO: 1560 - DNA, 16 bp, Triticum aestivum
cgcagcacacacgacc

SEQ ID NO: 1561 - DNA, 15 bp, Zea mays
cgcagcacacaggac

SEQ ID NO: 1562 - DNA, 15 bp, Zea mays
cgcagcacacaggac

SEQ ID NO: 1563 - DNA, 15 bp, Zea mays
cgcagcacacaggac

SEQ ID NO: 1564 - DNA, 16 bp, Zea mays
cgcagcacacacgacc

SEQ ID NO: 1565 - DNA, 16 bp, Zea mays
cgcagcacacacgacc

SEQ ID NO: 1566 - DNA, 15 bp, Zea mays
cgcagcacacaggac

SEQ ID NO: 1567 - DNA, 16 bp, Zea mays
cgcagcacacacgacc

SEQ ID NO: 1568 - DNA, 16 bp, Zea mays
cgcagcacacacgacc

SEQ ID NO: 1569 - DNA, 16 bp, Zea mays
cgcagcacacacgacc

SEQ ID NO: 1570 - DNA, 15 bp, Zea mays
cgcagcacacaggac

SEQ ID NO: 1571 - DNA, 15 bp, Zea mays
cgcagcacacaggac

SEQ ID NO: 1572 - DNA, 16 bp, Zea mays
cgcagcacacaggacc

SEQ ID NO: 1573 - DNA, 15 bp, Zea mays
cgcagcacacaggac

SEQ ID NO: 1574 - DNA, 16 bp, Zea mays
cgcagcacacacgacc

SEQ ID NO: 1575 - DNA, 15 bp, Zea mays
cgcagcacacaggac

SEQ ID NO: 1576 - DNA, 14 bp, Zea mays
cgcagcacacagga

SEQ ID NO: 1577 - DNA, 15 bp, Zea mays
cgcagcacacaggac

SEQ ID NO: 1578 - DNA, 15 bp, Zea mays
cgcagcacacaggac

SEQ ID NO: 1579 - DNA, 15 bp, Zea mays
cgcagcacacaggac

SEQ ID NO: 1580 - DNA, 15 bp, Zea mays
cgcagcacacaggac

SEQ ID NO: 1581 - DNA, 15 bp, Zea mays
ggcagcacacaggac

SEQ ID NO: 1582 - DNA, 15 bp, Zea mays
cgcagcacacaggac

SEQ ID NO: 1583 - DNA, 15 bp, Zea mays
cgcagcacacaggac

SEQ ID NO: 1584 - DNA, 20 bp, Zea mays
ttggactgaagggtgctccc

SEQ ID NO: 1585 - DNA, 490 bp, Oryza sativa
tgctttgcccccctcattccatttatgttttattcctgtcatcttcgtgacctagttagtttccttttctttgccgcgttgtttaagatttccattgtatttcttgttttgcaattcatttggtgctccaagattgtggctttgactacatgtgtaagaagagagctctcttcagtccactctcagatggctgtagggttttattagctgccgaatcatccattcacctaccaggaaagttgcaggagtgtatctcttggtagcggactggatgacgcgggagctaaaatttagctctgcgccgtttgtggttggactgaagggtgctcccttgctcaagcactcgtgcataaaatcatgccctaatgttaataataatcttcagatttctatatgagttttatgtccagtgtgttcagtttcaagatttggactttttttttatatcagtggtcaatgacctgggaaatctacagacagaaatctactg

SEQ ID NO: 1586 - DNA, 17 bp, Zea mays
agggggaccccagccaa

SEQ ID NO: 1587 - DNA, 17 bp, Zea mays
agggggaccccagccaa

SEQ ID NO: 1588 - DNA, 17 bp, Zea mays
agggggaccccagccaa

SEQ ID NO: 1589 - DNA, 16 bp, Zea mays
gggaacccccagccag

SEQ ID NO: 1590 - DNA, 16 bp, Zea mays
gggaacccccagccag

SEQ ID NO: 1591 - DNA, 16 bp, Zea mays
gggaacccccagccag

SEQ ID NO: 1592 - DNA, 17 bp, Zea mays
gggggacccccagccag

SEQ ID NO: 1593 - DNA, 17 bp, Zea mays
aggggacccccagccag

SEQ ID NO: 1594 - DNA, 17 bp, Zea mays
aggggacccccagccag

SEQ ID NO: 1595 - DNA, 20 bp, Zea mays
ttggcattctgtccacctcc

SEQ ID NO: 1596 - DNA, 640 bp, Zea mays; identical to SEQ ID NO: 1117

SEQ ID NO: 1597 - DNA, 640 bp, Artificial sequence
  Synthetic construct
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaagggagttcaagaagtcagcctgtggaattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 1598 - DNA, 640 bp, Artificial sequence
  Synthetic construct
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaaggcagttcaagaactcagctgtggaaattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 1599 - DNA, 640 bp, Artificial sequence; identical to SEQ ID NO: 1598
  Synthetic construct

SEQ ID NO: 1600 - DNA, 20 bp, Gossypium hirsutum
ggggggggacagaacgccga

SEQ ID NO: 1601 - DNA, 16 bp, Gossypium hirsutum
ggaggagaagaagcag

SEQ ID NO: 1602 - DNA, 18 bp, Gossypium hirsutum
ggaggggacagaagccaa

SEQ ID NO: 1603 - DNA, 17 bp, Gossypium hirsutum
ggagggacagaagccaa

SEQ ID NO: 1604 - DNA, 17 bp, Arabidopsis thaliana
gaggcggacagaagcgg

SEQ ID NO: 1605 - DNA, 17 bp, Arabidopsis thaliana
gcaggggacaaaagcaa

SEQ ID NO: 1606 - DNA, 17 bp, Arabidopsis thaliana
cgaggggacagcagcag

SEQ ID NO: 1607 - DNA, 17 bp, Arabidopsis thaliana
ggagggacagaagccaa

SEQ ID NO: 1608 - DNA, 17 bp, Brassica napus
agagaagacagaagcaa

SEQ ID NO: 1609 - DNA, 17 bp, Brassica napus
ggagggacagaagccaa

SEQ ID NO: 1610 - DNA, 17 bp, Glycine max
ggaggggacggagccgg

SEQ ID NO: 1611 - DNA, 17 bp, Glycine max
ggagggacagaagccaa

SEQ ID NO: 1612 - DNA, 17 bp, Glycine max
ggagggacagaagccaa

SEQ ID NO: 1613 - DNA, 17 bp, Glycine max
cgaggggacggaagcaa

SEQ ID NO: 1614 - DNA, 17 bp, Glycine max
gagcggacaggagccac

SEQ ID NO: 1615 - DNA, 15 bp, Glycine max
gaggggcagaagcag

SEQ ID NO: 1616 - DNA, 17 bp, Glycine max
gaagggacagaagccac

SEQ ID NO: 1617 - DNA, 17 bp, Hordeum vulgare
ggagcggcaggagccaa

SEQ ID NO: 1618 - DNA, 18 bp, Hordeum vulgare
ggaggggacagaagccaa

SEQ ID NO: 1619 - DNA, 18 bp, Hordeum vulgare
agagcggccagaagccag

SEQ ID NO: 1620 - DNA, 18 bp, Hordeum vulgare
ggaggggacaggcgccag

SEQ ID NO: 1621 - DNA, 16 bp, Hordeum vulgare
gaggggaagaaaccag

SEQ ID NO: 1622 - DNA, 18 bp, Oryza sativa
ggggcggacagaagcaac

SEQ ID NO: 1623 - DNA, 18 bp, Oryza sativa
ggggcggacagaagcaac

SEQ ID NO: 1624 - DNA, 17 bp, Oryza sativa
gaagggacagaagccag

SEQ ID NO: 1625 - DNA, 18 bp, Oryza sativa
ggaggggacagaagccaa

SEQ ID NO: 1626 - DNA, 15 bp, Oryza sativa
gaagggaagaagcag

SEQ ID NO: 1627 - DNA, 17 bp, Oryza sativa
ggaggggaggaagccgg

SEQ ID NO: 1628 - DNA, 17 bp, Oryza sativa
ggagggacagaagcaaa

SEQ ID NO: 1629 - DNA, 18 bp, Oryza sativa
ggaggggacagaagccaa

SEQ ID NO: 1630 - DNA, 18 bp, Oryza sativa
ggaggggacagaaggcgg

SEQ ID NO: 1631 - DNA, 18 bp, Sorghum bicolor
ggaggggacagaagccaa

SEQ ID NO: 1632 - DNA, 17 bp, Sorghum bicolor
cgaggggacaggagcga

SEQ ID NO: 1633 - DNA, 18 bp, Sorghum bicolor
ggaggaggacgggagcca

SEQ ID NO: 1634 - DNA, 18 bp, Sorghum bicolor
gggagaggacagaagcca

SEQ ID NO: 1635 - DNA, 17 bp, Triticum aestivum
cgggggacaggggccaa

SEQ ID NO: 1636 - DNA, 16 bp, Triticum aestivum
ggagggacagaagcca

SEQ ID NO: 1637 - DNA, 17 bp, Triticum aestivum
ggggggggcaaaagcaa

SEQ ID NO: 1638 - DNA, 18 bp, Triticum aestivum
ggaggggacagaagccaa

SEQ ID NO: 1639 - DNA, 18 bp, Triticum aestivum
ggggggggacagaagcag

SEQ ID NO: 1640 - DNA, 18 bp, Triticum aestivum
ggaggggacagaagccaa

SEQ ID NO: 1641 - DNA, 17 bp, Triticum aestivum
acagggacagaagccac

SEQ ID NO: 1642 - DNA, 18 bp, Triticum aestivum
ggaggggacaggcgccag

SEQ ID NO: 1643 - DNA, 18 bp, Triticum aestivum
ggagcggacaggcgccag

SEQ ID NO: 1644 - DNA, 17 bp, Triticum aestivum
acagggacagaagccac

SEQ ID NO: 1645 - DNA, 16 bp, Triticum aestivum
ggagggaggaagccgg

SEQ ID NO: 1646 - DNA, 18 bp, Triticum aestivum
ggaggggacagaagccaa

SEQ ID NO: 1647 - DNA, 18 bp, Triticum aestivum
ggaggggacagaagccaa

SEQ ID NO: 1648 - DNA, 18 bp, Triticum aestivum
ggaggaggacaggggcag

SEQ ID NO: 1649 - DNA, 18 bp, Zea mays
aaaggggacggaagccgg

SEQ ID NO: 1650 - DNA, 19 bp, Zea mays
ggggccggacaggagccaa

SEQ ID NO: 1651 - DNA, 19 bp, Zea mays
gggggggggcggaagccag

SEQ ID NO: 1652 - DNA, 18 bp, Zea mays
gcggaggacaggagccaa

SEQ ID NO: 1653 - DNA, 18 bp, Zea mays
gcggaggacaggagccaa

SEQ ID NO: 1654 - DNA, 17 bp, Zea mays
cgaggggaagaagccaa

SEQ ID NO: 1655 - DNA, 19 bp, Zea mays
ggacgaggacaggggccag

SEQ ID NO: 1656 - DNA, 18 bp, Zea mays
ggaggggacagaagccaa

SEQ ID NO: 1657 - DNA, 18 bp, Zea mays
gcggaggacaggagccaa

SEQ ID NO: 1658 - DNA, 18 bp, Zea mays
gcggaggacaggagccaa

SEQ ID NO: 1659 - DNA, 18 bp, Zea mays
gcggaggacaggagccaa

SEQ ID NO: 1660 - DNA, 15 bp, Zea mays
gagggaagaagccac

SEQ ID NO: 1661 - DNA, 17 bp, Zea mays
ggagcgacagaggccac

SEQ ID NO: 1662 - DNA, 17 bp, Zea mays
ggaggcgacggagccag

SEQ ID NO: 1663 - DNA, 18 bp, Zea mays
agaggggacgggagccgg

SEQ ID NO: 1664 - DNA, 18 bp, Zea mays
gaggggggcaaaagccaa

SEQ ID NO: 1665 - DNA, 19 bp, Zea mays
ggaggcggacagaagccaa

SEQ ID NO: 1666 - DNA, 17 bp, Zea mays
ggagggacaggaggcag

SEQ ID NO: 1667 - DNA, 18 bp, Zea mays
ggaggggacagaagccaa

SEQ ID NO: 1668 - DNA, 18 bp, Zea mays
gcggaggacaggagccaa

SEQ ID NO: 1669 - DNA, 16 bp, Zea mays
ggaagggaagaagcca

SEQ ID NO: 1670 - DNA, 19 bp, Zea mays
ggggggggccagaagccaa

SEQ ID NO: 1671 - DNA, 18 bp, Zea mays
ggggggggacagaaccca

SEQ ID NO: 1672 - DNA, 21 bp, Zea mays
tccaaagggatcgcattgatc

SEQ ID NO: 1673 - DNA, 16 bp, Gossypium hirsutum
agacaagcgacccgga

SEQ ID NO: 1674 - DNA, 16 bp, Gossypium hirsutum
aaacaagcgacccgga

SEQ ID NO: 1675 - DNA, 16 bp, Gossypium hirsutum
aaacaagcgacccgga

SEQ ID NO: 1676 - DNA, 16 bp, Gossypium hirsutum
agacaagcgacccgga

SEQ ID NO: 1677 - DNA, 16 bp, Gossypium hirsutum
aaacaagcgacccgga

SEQ ID NO: 1678 - DNA, 16 bp, Arabidopsis thaliana
aaacaagcgacccgga

SEQ ID NO: 1679 - DNA, 16 bp, Arabidopsis thaliana
aaacaagcgacccgga

SEQ ID NO: 1680 - DNA, 16 bp, Arabidopsis thaliana
agacaagcgacccgga

SEQ ID NO: 1681 - DNA, 16 bp, Arabidopsis thaliana
agaccagcgacccgga

SEQ ID NO: 1682 - DNA, 16 bp, Arabidopsis thaliana
aaacaagcgacccgga

SEQ ID NO: 1683 - DNA, 16 bp, Brassica napus
gaacaagcgacccgga

SEQ ID NO: 1684 - DNA, 15 bp, Brassica napus
agacaagcgaccgga

SEQ ID NO: 1685 - DNA, 15 bp, Brassica napus
agacaagcgaccgga

SEQ ID NO: 1686 - DNA, 16 bp, Brassica rapa
aaacaagcgacccgga

SEQ ID NO: 1687 - DNA, 16 bp, Glycine max
aaacgagcgacccgga

SEQ ID NO: 1688 - DNA, 16 bp, Glycine max
aaacaagcgacccgga

SEQ ID NO: 1689 - DNA, 16 bp, Glycine max
aaacaagcgacccgga

SEQ ID NO: 1690 - DNA, 16 bp, Glycine max
agacaagcgacccgga

SEQ ID NO: 1691 - DNA, 16 bp, Glycine max
agacaagcgacccgga

SEQ ID NO: 1692 - DNA, 16 bp, Glycine max
aaacgagcgacccgga

SEQ ID NO: 1693 - DNA, 16 bp, Glycine max
aaacaagcgacccgga

SEQ ID NO: 1694 - DNA, 16 bp, Medicago truncatula
aaacaagcgacccgga

SEQ ID NO: 1695 - DNA, 16 bp, Medicago truncatula
agacaagcgacccgga

SEQ ID NO: 1696 - DNA, 16 bp, Hordeum vulgare
agacaagcgacccgga

SEQ ID NO: 1697 - DNA, 16 bp, Hordeum vulgare
agacaagcgacccgga

SEQ ID NO: 1698 - DNA, 16 bp, Oryza sativa
agacaagcgacccgga

SEQ ID NO: 1699 - DNA, 16 bp, Oryza sativa
agacaagcgacccgga

SEQ ID NO: 1700 - DNA, 16 bp, Oryza sativa
agacaagcgacccgga

SEQ ID NO: 1701 - DNA, 16 bp, Sorghum bicolor
agacaagcgacccgga

SEQ ID NO: 1702 - DNA, 16 bp, Sorghum bicolor
agacaagcgacccgga

SEQ ID NO: 1703 - DNA, 16 bp, Triticum aestivum
agacaagcgacccgga

SEQ ID NO: 1704 - DNA, 16 bp, Triticum aestivum
agacaaccgacccgga

SEQ ID NO: 1705 - DNA, 16 bp, Triticum aestivum
agacaagcgacccgga

SEQ ID NO: 1706 - DNA, 16 bp, Triticum aestivum
agacaagcgacccgga

SEQ ID NO: 1707 - DNA, 16 bp, Zea mays
agacaagcgacccgga

SEQ ID NO: 1708 - DNA, 16 bp, Zea mays
agacaagcgacccgga

SEQ ID NO: 1709 - DNA, 16 bp, Zea mays
agacaagcgacccgga

SEQ ID NO: 1710 - DNA, 16 bp, Zea mays
agacaagcgacccgga

SEQ ID NO: 1711 - DNA, 20 bp, Zea mays
tgaagtgtttgggggaactc

SEQ ID NO: 1712 - DNA, 640 bp, Zea mays; identical to SEQ ID NO: 1117

SEQ ID NO: 1713 - DNA, 639 bp, Artificial sequence
  Synthetic construct
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaaggcagttcccccactaaacacttcaattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 1714 - DNA, 14 bp, Gossypium hirsutum
gagccccaaaccca

SEQ ID NO: 1715 - DNA, 14 bp, Gossypium hirsutum
gagccccaaaccca

SEQ ID NO: 1716 - DNA, 15 bp, Arabidopsis thaliana
gagccccaaacacca

SEQ ID NO: 1717 - DNA, 16 bp, Arabidopsis thaliana
aaggccccaaacacca

SEQ ID NO: 1718 - DNA, 14 bp, Arabidopsis thaliana
gagccccaaaccca

SEQ ID NO: 1719 - DNA, 15 bp, Arabidopsis thaliana
gagccccaaacacca

SEQ ID NO: 1720 - DNA, 15 bp, Arabidopsis thaliana
aagccccaaacacca

SEQ ID NO: 1721 - DNA, 15 bp, Arabidopsis thaliana
gagccccaaacacca

SEQ ID NO: 1722 - DNA, 12 bp, Arabidopsis thaliana
aagccaaacaca

SEQ ID NO: 1723 - DNA, 15 bp, Brassica napus
gagccccaaacacca

SEQ ID NO: 1724 - DNA, 14 bp, Brassica napus
gagccccaaaccca

SEQ ID NO: 1725 - DNA, 14 bp, Brassica napus
gagccccaaaccca

SEQ ID NO: 1726 - DNA, 14 bp, Brassica rapa
gagccccaaaccca

SEQ ID NO: 1727 - DNA, 15 bp, Brassica rapa
gagccccaaacacca

SEQ ID NO: 1728 - DNA, 14 bp, Brassica rapa
gagccccaaaccca

SEQ ID NO: 1729 - DNA, 15 bp, Brassica oleracea
aagccccaaacacca

SEQ ID NO: 1730 - DNA, 15 bp, Glycine max
gagccccaaacacca

SEQ ID NO: 1731 - DNA, 16 bp, Glycine max
aagcacccaaacacca

SEQ ID NO: 1732 - DNA, 15 bp, Glycine max
gagccccaaacgcca

SEQ ID NO: 1733 - DNA, 15 bp, Glycine max
aagccccaaacacca

SEQ ID NO: 1734 - DNA, 15 bp, Glycine max
gagccccaaacgcca

SEQ ID NO: 1735 - DNA, 15 bp, Oryza sativa
gagccccaagcacca

SEQ ID NO: 1736 - DNA, 16 bp, Oryza sativa
gagcacccaaacacca

SEQ ID NO: 1737 - DNA, 15 bp, Sorghum bicolor
gagccccaagcacca

SEQ ID NO: 1738 - DNA, 15 bp, Sorghum bicolor
gagccccaaacacca

SEQ ID NO: 1739 - DNA, 16 bp, Triticum aestivum
gagcccccaaacacca

SEQ ID NO: 1740 - DNA, 15 bp, Triticum aestivum
gagccccaagcacca

SEQ ID NO: 1741 - DNA, 15 bp, Triticum aestivum
gagccccaagcacca

SEQ ID NO: 1742 - DNA, 15 bp, Triticum aestivum
gagccccaagcacca

SEQ ID NO: 1743 - DNA, 15 bp, Triticum aestivum
gaggcccaagcacca

SEQ ID NO: 1744 - DNA, 15 bp, Triticum aestivum
cagcccccaaacacc

SEQ ID NO: 1745 - DNA, 15 bp, Zea mays
gagccccaaacacca

SEQ ID NO: 1746 - DNA, 15 bp, Zea mays
gagccccaaacacca

SEQ ID NO: 1747 - DNA, 15 bp, Zea mays
gagccccaagcacca

SEQ ID NO: 1748 - DNA, 15 bp, Zea mays
gagccccaaacacca

SEQ ID NO: 1749 - DNA, 15 bp, Zea mays
gagccccaagcacca

SEQ ID NO: 1750 - DNA, 21 bp, Zea mays
tgtgttctcaggtcgcccccg

SEQ ID NO: 1751 - DNA, 640 bp, Zea mays; identical to SEQ ID NO: 1117

SEQ ID NO: 1752 - DNA, 640 bp, Artificial sequence
  Synthetic construct
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaagggaggggcgaccgtatgagaacacaattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 1753 - DNA, 640 bp, Artificial sequence
  Synthetic construct
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaaggcaggggtgaccgtatgagaacacaattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 1754 - DNA, 19 bp, Arabidopsis thaliana
cagggggaccgagaacaca

SEQ ID NO: 1755 - DNA, 18 bp, Brassica napus
cgggggcaccgagacaca

SEQ ID NO: 1756 - DNA, 18 bp, Glycine max
caggggaccgaaaacaca

SEQ ID NO: 1757 - DNA, 18 bp, Glycine max
cgggggcaccgagacaca

SEQ ID NO: 1758 - DNA, 18 bp, Oryza sativa
cgggggcgccgagacaca

SEQ ID NO: 1759 - DNA, 18 bp, Oryza sativa
cgggggcgccgagacaca

SEQ ID NO: 1760 - DNA, 19 bp, Oryza sativa
caggggcgccgagaacaca

SEQ ID NO: 1761 - DNA, 18 bp, Sorghum bicolor
cgggggcgccgagacaca

SEQ ID NO: 1762 - DNA, 19 bp, Sorghum bicolor
cgggggccgccgagacaca

SEQ ID NO: 1763 - DNA, 19 bp, Triticum aestivum
ccgccggaccgagagcaca

SEQ ID NO: 1764 - DNA, 18 bp, Triticum aestivum
cgggggcaccgagacaca

SEQ ID NO: 1765 - DNA, 18 bp, Triticum aestivum
cgggggcgccgagacaca

SEQ ID NO: 1766 - DNA, 19 bp, Triticum aestivum
ccgccggaccgagagcaca

SEQ ID NO: 1767 - DNA, 18 bp, Triticum aestivum
ccggggcaccgagacaca

SEQ ID NO: 1768 - DNA, 18 bp, Triticum aestivum
ccggggcaccgagacaca

SEQ ID NO: 1769 - DNA, 19 bp, Triticum aestivum
ccgccggaccgagagcaca

SEQ ID NO: 1770 - DNA, 19 bp, Triticum aestivum
ccgccggaccgagagcaca

SEQ ID NO: 1771 - DNA, 18 bp, Triticum aestivum
cgggggcaccgagacaca

SEQ ID NO: 1772 - DNA, 18 bp, Triticum aestivum
cgggggcaccgagacaca

SEQ ID NO: 1773 - DNA, 19 bp, Triticum aestivum
ccgccggaccgagagcaca

SEQ ID NO: 1774 - DNA, 19 bp, Triticum aestivum
ccgccggaccgagagcaca

SEQ ID NO: 1775 - DNA, 19 bp, Triticum aestivum
ccgccggaccgagagcaca

SEQ ID NO: 1776 - DNA, 18 bp, Triticum aestivum
cgggggcaccgagacaca

SEQ ID NO: 1777 - DNA, 18 bp, Triticum aestivum
cgggggcaccgagacaca

SEQ ID NO: 1778 - DNA, 19 bp, Triticum aestivum
ccgccggaccgagagcaca

SEQ ID NO: 1779 - DNA, 18 bp, Triticum aestivum
cgggggcaccgagacaca

SEQ ID NO: 1780 - DNA, 18 bp, Triticum aestivum
ccggggcaccgagacaca

SEQ ID NO: 1781 - DNA, 18 bp, Zea mays
cgggggcgccgagacaca

SEQ ID NO: 1782 - DNA, 18 bp, Zea mays
cgggggcgccgagacaca

SEQ ID NO: 1783 - DNA, 18 bp, Zea mays
cgggggcgccgagacaca

SEQ ID NO: 1784 - DNA, 18 bp, Zea mays
cgggggcgccgagacaca

SEQ ID NO: 1785 - DNA, 18 bp, Zea mays
cgggggcgccgagacaca

SEQ ID NO: 1786 - DNA, 18 bp, Zea mays
cgggggcgccgagacaca

SEQ ID NO: 1787 - DNA, 18 bp, Zea mays
cgggggcgccgagacaca

SEQ ID NO: 1788 - DNA, 20 bp, Zea mays
cggggagagccgagaacaca

SEQ ID NO: 1789 - DNA, 18 bp, Zea mays
cgggggcgccgagacaca

SEQ ID NO: 1790 - DNA, 18 bp, Zea mays
cgggggcgccgagacaca

SEQ ID NO: 1791 - DNA, 18 bp, Zea mays
cgggggcgccgagacaca

SEQ ID NO: 1792 - DNA, 18 bp, Zea mays
cgggggcgccgagacaca

SEQ ID NO: 1793 - DNA, 18 bp, Zea mays
cgggggcgccgagacaca

SEQ ID NO: 1794 - DNA, 18 bp, Zea mays
cgggggcgccgagacaca

SEQ ID NO: 1795 - DNA, 19 bp, Zea mays
cgggggccgccgagacaca

SEQ ID NO: 1796 - DNA, 21 bp, Zea mays
tgccaaaggagaattgccctg

SEQ ID NO: 1797 - DNA, 21 bp, Zea mays
tgccaaaggagagctgtcctg

SEQ ID NO: 1798 - DNA, 21 bp, Zea mays
tgccaaaggagagctgccctg

SEQ ID NO: 1799 - DNA, 21 bp, Zea mays
tgccaaaggagagttgccctg

SEQ ID NO: 1800 - DNA, 640 bp, Zea mays; identical to SEQ ID NO: 1117

SEQ ID NO: 1801 - DNA, 640 bp, Artificial sequence; identical to SEQ ID NO: 1117
  Synthetic construct

SEQ ID NO: 1802 - DNA, 336 bp, Artificial sequence
  Synthetic construct
aattcattacattgataaaacacaattcaaaagatcaatgttccacttcatgcaaagacatttccaaaatatgtgtaggtagaggggttttacaggatcgtccacggtttccagtaaacgggacccacatgatgcagctatgtttgctatgtcccgtttactcgataccgtggtcgcccttgttggactgtccaactcctactgattgcggatgcacttgccacaaatgaaaatcaaagcgaggggaaaagaatgtagagtgtgactacgattgcatgcatgtgatttaggtaattaagttacatgattgtctaattgtgtttatggaattgtata

SEQ ID NO: 1803 - DNA, 14 bp, Arabidopsis thaliana
agggcaaaccggca

SEQ ID NO: 1804 - DNA, 15 bp, Glycine max
cgggcaaacccggca

SEQ ID NO: 1805 - DNA, 14 bp, Glycine max
cagggcaacccggc

SEQ ID NO: 1806 - DNA, 15 bp, Medicago truncatula
cgggcaaacccggca

SEQ ID NO: 1807 - DNA, 15 bp, Medicago truncatula
ggggcaaacccggca

SEQ ID NO: 1808 - DNA, 16 bp, Medicago truncatula
cagggcaaacccggca

SEQ ID NO: 1809 - DNA, 15 bp, Medicago truncatula
cagggcaaaccggca

SEQ ID NO: 1810 - DNA, 14 bp, Medicago truncatula
cagggcaacccggc

SEQ ID NO: 1811 - DNA, 16 bp, Oryza sativa
cagggcaaccccggca

SEQ ID NO: 1812 - DNA, 14 bp, Oryza sativa
cagggcaacccggc

SEQ ID NO: 1813 - DNA, 15 bp, Oryza sativa
agggcaaacccggca

SEQ ID NO: 1814 - DNA, 15 bp, Oryza sativa
agggcaaacccggca

SEQ ID NO: 1815 - DNA, 15 bp, Sorghum bicolor
agggcaaacccggca

SEQ ID NO: 1816 - DNA, 15 bp, Sorghum bicolor
cgggcaaacccggca

SEQ ID NO: 1817 - DNA, 15 bp, Triticum aestivum
agggcaaacccggcg

SEQ ID NO: 1818 - DNA, 20 bp, Zea mays
tgcactgcctcttccctggc

SEQ ID NO: 1819 - DNA, 640 bp, Zea mays; identical to SEQ ID NO: 1117

SEQ ID NO: 1820 - DNA, 641 bp, Artificial sequence
  Synthetic construct
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaaggtccagggaagactaggcagtgcatgattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 1821 - DNA, 19 bp, Gossypium hirsutum
cgcagggaaggggcaggca

SEQ ID NO: 1822 - DNA, 19 bp, Gossypium hirsutum
cgcagggaaggggcaggca

SEQ ID NO: 1823 - DNA, 19 bp, Arabidopsis thaliana
  misc_feature (19)..(19): n is a, c, g, or t
ccaagggaagaggcaggcn

SEQ ID NO: 1824 - DNA, 17 bp, Arabidopsis thaliana
gccgggaagaggcggca

SEQ ID NO: 1825 - DNA, 17 bp, Arabidopsis thaliana
gccgggaagaggcggca

SEQ ID NO: 1826 - DNA, 19 bp, Arabidopsis thaliana
ccaagggaagaggcaggca

SEQ ID NO: 1827 - DNA, 19 bp, Brassica napus
ccaagggaagaggcaggca

SEQ ID NO: 1828 - DNA, 19 bp, Brassica rapa
ccaagggaagaggcaggca

SEQ ID NO: 1829 - DNA, 16 bp, Glycine max
cgggaagaggcaggca

SEQ ID NO: 1830 - DNA, 17 bp, Glycine max
ccgggaagaggcaggca

SEQ ID NO: 1831 - DNA, 18 bp, Glycine max
ccagggaagaggcaggcg

SEQ ID NO: 1832 - DNA, 17 bp, Glycine max
gcagggaagaggcaggc

SEQ ID NO: 1833 - DNA, 18 bp, Glycine max
ccagggaagaggcaggca

SEQ ID NO: 1834 - DNA, 17 bp, Glycine max
gccaggaagaggcggca

SEQ ID NO: 1835 - DNA, 17 bp, Glycine max
gccaggaggaggcggca

SEQ ID NO: 1836 - DNA, 18 bp, Glycine max
ccagggaagaggcaggca

SEQ ID NO: 1837 - DNA, 18 bp, Glycine max
ccagggaagaggcaggca

SEQ ID NO: 1838 - DNA, 17 bp, Glycine max
ccgggaagaggcaggca

SEQ ID NO: 1839 - DNA, 18 bp, Glycine max
ccagggaagaggcaggca

SEQ ID NO: 1840 - DNA, 17 bp, Glycine max
ccgggaagaggcaggca

SEQ ID NO: 1841 - DNA, 17 bp, Glycine max
ccgggaagaggcaggca

SEQ ID NO: 1842 - DNA, 17 bp, Glycine max
ccgggaagaggcaggca

SEQ ID NO: 1843 - DNA, 18 bp, Medicago truncatula
caagggaagaggcaggca

SEQ ID NO: 1844 - DNA, 17 bp, Medicago truncatula
cgagggaagaggcaggc

SEQ ID NO: 1845 - DNA, 17 bp, Medicago truncatula
gcagggaagagacaggc

SEQ ID NO: 1846 - DNA, 17 bp, Medicago truncatula
ccgggaagaggcaggca

SEQ ID NO: 1847 - DNA, 17 bp, Medicago truncatula
gcagggaagagacaggc

SEQ ID NO: 1848 - DNA, 19 bp, Hordeum vulgare
cgcagggaagaggcaggca

SEQ ID NO: 1849 - DNA, 18 bp, Hordeum vulgare
ccagggaagaggcaggcg

SEQ ID NO: 1850 - DNA, 19 bp, Hordeum vulgare
cgcagggaagaggcaggcc

SEQ ID NO: 1851 - DNA, 17 bp, Hordeum vulgare
gcaggcaagaggcaggc

SEQ ID NO: 1852 - DNA, 17 bp, Hordeum vulgare
cgggggaagaggcaggc

SEQ ID NO: 1853 - DNA, 18 bp, Oryza sativa
gccaggaggaggcaggca

SEQ ID NO: 1854 - DNA, 18 bp, Oryza sativa
gccaggaagaggcaggca

SEQ ID NO: 1855 - DNA, 17 bp, Oryza sativa
gccgggaagaggcggca

SEQ ID NO: 1856 - DNA, 16 bp, Oryza sativa
gcaggaagaggcggca

SEQ ID NO: 1857 - DNA, 18 bp, Oryza sativa
gccaggaagaggcaggca

SEQ ID NO: 1858 - DNA, 18 bp, Oryza sativa
gccaggaagaggcaggca

SEQ ID NO: 1859 - DNA, 17 bp, Oryza sativa
gcaggcaagaggcaggc

SEQ ID NO: 1860 - DNA, 17 bp, Oryza sativa
ccagggaaggggcaggc

SEQ ID NO: 1861 - DNA, 17 bp, Oryza sativa
gccgggaagaggcggca

SEQ ID NO: 1862 - DNA, 18 bp, Oryza sativa
ccggggaagaggcaggca

SEQ ID NO: 1863 - DNA, 19 bp, Oryza sativa
cccagggaagaggcaggca

SEQ ID NO: 1864 - DNA, 17 bp, Oryza sativa
ccagggaaggggcaggc

SEQ ID NO: 1865 - DNA, 17 bp, Sorghum bicolor
gcaggcaagaggcaggc

SEQ ID NO: 1866 - DNA, 17 bp, Sorghum bicolor
ccagggaaggggcaggc

SEQ ID NO: 1867 - DNA, 18 bp, Sorghum bicolor
ccggggaagaggcaggcc

SEQ ID NO: 1868 - DNA, 18 bp, Sorghum bicolor
ccagggaaggggcaggcg

SEQ ID NO: 1869 - DNA, 17 bp, Sorghum bicolor
gccgggaagaggcggca

SEQ ID NO: 1870 - DNA, 18 bp, Sorghum bicolor
ccggggaagaggcaggcc

SEQ ID NO: 1871 - DNA, 19 bp, Sorghum bicolor
agcagggaagaggcaggga

SEQ ID NO: 1872 - DNA, 17 bp, Triticum aestivum
cggggaagaggcaagca

SEQ ID NO: 1873 - DNA, 18 bp, Triticum aestivum
ccagggaagaggcaggcg

SEQ ID NO: 1874 - DNA, 17 bp, Triticum aestivum
gccgggaagaggagcca

SEQ ID NO: 1875 - DNA, 17 bp, Triticum aestivum
gcaggcaagaggcaggc

SEQ ID NO: 1876 - DNA, 18 bp, Triticum aestivum
ccagggaagaggcaggcg

SEQ ID NO: 1877 - DNA, 17 bp, Triticum aestivum
gcaggaagaggccggca

SEQ ID NO: 1878 - DNA, 19 bp, Triticum aestivum
cccagggaagaggcgggcg

SEQ ID NO: 1879 - DNA, 19 bp, Triticum aestivum
cgcagggaagaggcaggcc

SEQ ID NO: 1880 - DNA, 19 bp, Triticum aestivum
gccagggcagaggcaggca

SEQ ID NO: 1881 - DNA, 19 bp, Triticum aestivum
cgcagggaagaggcaggcc

SEQ ID NO: 1882 - DNA, 17 bp, Triticum aestivum
ccgggaagaggcaggcg

SEQ ID NO: 1883 - DNA, 19 bp, Triticum aestivum
cccagggaagaggcaggca

SEQ ID NO: 1884 - DNA, 19 bp, Triticum aestivum
cccagggaagaggcaggca

SEQ ID NO: 1885 - DNA, 18 bp, Triticum aestivum
gacagggggaggcaggca

SEQ ID NO: 1886 - DNA, 18 bp, Triticum aestivum
ccagggaagaggaaggcg

SEQ ID NO: 1887 - DNA, 18 bp, Triticum aestivum
ccagggaagaggcgggcg

SEQ ID NO: 1888 - DNA, 17 bp, Triticum aestivum
ccgggaagaggcaggca

SEQ ID NO: 1889 - DNA, 19 bp, Triticum aestivum
ccgggggaagaggcgggca

SEQ ID NO: 1890 - DNA, 17 bp, Triticum aestivum
gccgggaagaggcggcg

SEQ ID NO: 1891 - DNA, 16 bp, Zea mays
gcagggaagggcaggc

SEQ ID NO: 1892 - DNA, 17 bp, Zea mays
gcaggcaagaggcaggc

SEQ ID NO: 1893 - DNA, 18 bp, Zea mays
ccagggaagaggcaggcg

SEQ ID NO: 1894 - DNA, 17 bp, Zea mays
gccaggaagaggcggca

SEQ ID NO: 1895 - DNA, 18 bp, Zea mays
ccggggaagaggcaggca

SEQ ID NO: 1896 - DNA, 18 bp, Zea mays
cgagggaagaggcaggca

SEQ ID NO: 1897 - DNA, 17 bp, Zea mays
gcaggcaagaggcaggc

SEQ ID NO: 1898 - DNA, 17 bp, Zea mays
ccgggaagaggcaggca

SEQ ID NO: 1899 - DNA, 18 bp, Zea mays
ggcagggaagaggcaggg

SEQ ID NO: 1900 - DNA, 18 bp, Zea mays
ggcagggaagaggcaggg

SEQ ID NO: 1901 - DNA, 19 bp, Zea mays
gccagggaggagacaggcc

SEQ ID NO: 1902 - DNA, 17 bp, Zea mays
gccgggaagaggcggca

SEQ ID NO: 1903 - DNA, 18 bp, Zea mays
ggcagggaagaggcaggg

SEQ ID NO: 1904 - DNA, 17 bp, Zea mays
gccgggaagaggcggca

SEQ ID NO: 1905 - DNA, 18 bp, Zea mays
gcagggaaaaggcaggcg

SEQ ID NO: 1906 - DNA, 18 bp, Zea mays
ccagggaagaggcaggcg

SEQ ID NO: 1907 - DNA, 18 bp, Zea mays
ccagggaagaggcaggcg

SEQ ID NO: 1908 - DNA, 17 bp, Zea mays
gccaggaagaggcggca

SEQ ID NO: 1909 - DNA, 17 bp, Zea mays
gccaggaagaggcggca

SEQ ID NO: 1910 - DNA, 18 bp, Zea mays
gcagggaaaaggcaggcg

SEQ ID NO: 1911 - DNA, 18 bp, Zea mays
ccaggggagagacaggca

SEQ ID NO: 1912 - DNA, 16 bp, Zea mays
ccagggaagggcaggc

SEQ ID NO: 1913 - DNA, 19 bp, Zea mays
gccagggaggagacaggcc

SEQ ID NO: 1914 - DNA, 16 bp, Zea mays
ccagggaagggcaggc

SEQ ID NO: 1915 - DNA, 18 bp, Zea mays
cgagggaagaggcaggca

SEQ ID NO: 1916 - DNA, 17 bp, Zea mays
gcagggaagagacgggc

SEQ ID NO: 1917 - DNA, 17 bp, Zea mays
gccaggaagaggcggca

SEQ ID NO: 1918 - DNA, 18 bp, Zea mays
ggcagggaagaggcaggg

SEQ ID NO: 1919 - DNA, 19 bp, Zea mays
gccagggaggagacaggcc

SEQ ID NO: 1920 - DNA, 17 bp, Zea mays
gccgggaagaggcggca

SEQ ID NO: 1921 - DNA, 17 bp, Zea mays
gccgggaagaggcggca

SEQ ID NO: 1922 - DNA, 18 bp, Zea mays
ccaggggagagacaggca

SEQ ID NO: 1923 - DNA, 18 bp, Zea mays
cgagggaagaggcaggca

SEQ ID NO: 1924 - DNA, 18 bp, Zea mays
ggcagggaagaggcaggg

SEQ ID NO: 1925 - DNA, 17 bp, Zea mays
ccagggaaggggcaggc

SEQ ID NO: 1926 - DNA, 21 bp, Zea mays
tgttgtctcaagcttgctgcc

SEQ ID NO: 1927 - DNA, 710 bp, Zea mays
ccgttgcttccccgttagcttctcccttgtcacaccccctcgcttcgttctgcgtagtttcggggtttgacaccgcttgtctatcccgttcctatagcttttagggtttcgagctcaaactccgcgccggcatctcagttgctgcaagtggcggcggcaagctagaggcagcaactgcataccttgcaagaaaaaatcggttttgttgacgtaccgatgattttcttgcaagttgtgcagttgttgtctcaagcttgctgcctccctttgccagaactattgaatgtgaaagcacagttaagtaatgccacgcccagagaatccaaaaggttgctgatataaaaagttgctaataagtggtggaacttttagcggagtaaaattgtatgcctttatgaaataactgaagtagatatgttggcatgctattgtttgaatcaagaaatgatattatatactccctccgtcccaaaatattagtcgttttagccattgaatttatgtctatatttaaatgaatgacaatgaatctatatataatataaaacacatacattaagtattgtatgaatctagtaaaatgctaaaacgactaatattttgggacggagggagtacaaaataacaagacgagaaatgactgtatgaaatcaattaaggcaaatacaaaacctcttcatcttgtgttgatattttatttcagacacata

SEQ ID NO: 1928 - DNA, 684 bp, Oryza sativa
atggggagagggaagattgccatcaagaggatcgacaacacgatgaaccggcaggtgaccttctcgaagcggcgcggcgggctgatgaagaaggcccgggagctggccatcctctgcgacgccgacgtcggcctcattgtcttctcctgcaccggccgcctctacgacttctccagctcaagcatgaaatcaataatagagcggtaccaggaggcaggagaggagcattgtcggttgctgaacccaatgtcagaggctaagttttggcagcgggaggttacaactttgaggcagcaagtgcaaaacttacaccacaacaacaggcaacttttgggagaggaaatctccaacttcacagttagagatctgcagcttctccagaaccaagttgagatgagcctacattccataagaaataaaaaggatcaacttttggcagaggagattctaaaactcaatgaaaaggggtctcttgttcaaaaggagaacagtgaacttcgcaagaagttcaacattgctcatcaacgcaacatagaattacacaagaagcttaactctggagaaagcacgtcaagtgagcaagttaccagaagctcaaaggatcccggagaatcgagtacaccccgtgattcacgtgtgtgtattgaccttgaattgagtcaaaaagaagttgaagatgaatag

SEQ ID NO: 1929 - DNA, 684 bp, Artificial sequence
  Synthetic construct
atggggagagggaagattgccatcaagaggatcgacaacacgatgaaccggcaggtgaccttctcgaagcggcgcggcgggctgatgaagaaggcccgggagctggccatcctctgcgacgccgacgtcggcctcattgtcttctcctgcaccggccgcctctacgacttctccagctcaagcatgaaatcaataatagagcggtaccaggaggcaggagaggagcattgtcggttgctgaacccaatgtcagaggctaagttttggcagcgggaggttacaactctccgacagcaggtacaaaacttacaccacaacaacaggcaacttttgggagaggaaatctccaacttcacagttagagatctgcagcttctccagaaccaagttgagatgagcctacattccataagaaataaaaaggatcaacttttggcagaggagattctaaaactcaatgaaaaggggtctcttgttcaaaaggagaacagtgaacttcgcaagaagttcaacattgctcatcaacgcaacatagaattacacaagaagcttaactctggagaaagcacgtcaagtgagcaagttaccagaagctcaaaggatcccggagaatcgagtacaccccgtgattcacgtgtgtgtattgaccttgaattgagtcaaaaagaagttgaagatgaatag

SEQ ID NO: 1930 - DNA, 640 bp, Zea mays; identical to SEQ ID NO: 1117

SEQ ID NO: 1931 - DNA, 640 bp, Artificial sequence
  Synthetic construct
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaaggccagcaagcttctagaggcagcaaattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 1932 - DNA, 18 bp, Glycine max
agagcaagcgcggcaaca

SEQ ID NO: 1933 - DNA, 19 bp, Glycine max
agcagcaagcgaggcaaca

SEQ ID NO: 1934 - DNA, 19 bp, Medicago truncatula
agcagcaagcgaggcaaca

SEQ ID NO: 1935 - DNA, 20 bp, Hordeum vulgare
ggcaccaagcagaggcaaca

SEQ ID NO: 1936 - DNA, 20 bp, Hordeum vulgare
ggcaccaagcagaggcaaca

SEQ ID NO: 1937 - DNA, 19 bp, Oryza sativa
ggcagcaagcgagacaaca

SEQ ID NO: 1938 - DNA, 19 bp, Oryza sativa
ggcagcaagcgagacaaca

SEQ ID NO: 1939 - DNA, 19 bp, Oryza sativa
ggcagcaagcgaggcagca

SEQ ID NO: 1940 - DNA, 19 bp, Oryza sativa
ggcagcaagcgaggcagca

SEQ ID NO: 1941 - DNA, 20 bp, Oryza sativa
ggcaccaagcagaggcaaca

SEQ ID NO: 1942 - DNA, 19 bp, Oryza sativa
ggcagcaagcgagacaaca

SEQ ID NO: 1943 - DNA, 19 bp, Oryza sativa
ggcagcaagcgaggcagca

SEQ ID NO: 1944 - DNA, 20 bp, Oryza sativa
ggcggcaagcagagacagca

SEQ ID NO: 1945 - DNA, 20 bp, Oryza sativa
ggcaccaagcagaggcaaca

SEQ ID NO: 1946 - DNA, 19 bp, Oryza sativa
ggcagcaagcgaggcagca

SEQ ID NO: 1947 - DNA, 19 bp, Sorghum bicolor
ggcaacaagcgagacaaca

SEQ ID NO: 1948 - DNA, 19 bp, Sorghum bicolor
ggcagcaagcgaggcaaca

SEQ ID NO: 1949 - DNA, 19 bp, Sorghum bicolor
ggcagcaagcgagacaaca

SEQ ID NO: 1950 - DNA, 19 bp, Sorghum bicolor
ggcagcaagcgaggcaaca

SEQ ID NO: 1951 - DNA, 19 bp, Triticum aestivum
ggcagcaagcgaggcagca

SEQ ID NO: 1952 - DNA, 19 bp, Triticum aestivum
ggcagcaagcgagacaaca

SEQ ID NO: 1953 - DNA, 20 bp, Triticum aestivum
ggcggcaagcagagacagca

SEQ ID NO: 1954 - DNA, 19 bp, Zea mays
ggcagcaagcgaggcaaca

SEQ ID NO: 1955 - DNA, 19 bp, Zea mays
ggcagcaagcgagacaaca

SEQ ID NO: 1956 - DNA, 20 bp, Zea mays
ggcggcaagcagaggcagca

SEQ ID NO: 1957 - DNA, 19 bp, Zea mays
ggcagcaagcgagacaaca

SEQ ID NO: 1958 - DNA, 19 bp, Zea mays
ggcagcaagcgaggcaaca

SEQ ID NO: 1959 - DNA, 19 bp, Zea mays
ggcagcaagcgagacaaca

SEQ ID NO: 1960 - DNA, 20 bp, Zea mays
ggcagcaagcagaggcagca

SEQ ID NO: 1961 - DNA, 20 bp, Zea mays
ggcagcaagcagaggcagca

SEQ ID NO: 1962 - DNA, 20 bp, Zea mays
ggcggcaagcagaggcagca

SEQ ID NO: 1963 - DNA, 20 bp, Zea mays
ggcagcaagcagaggcagca

SEQ ID NO: 1964 - DNA, 19 bp, Zea mays
ggcagaaagcgaggcagca

SEQ ID NO: 1965 - DNA, 20 bp, Zea mays
ggcggcaagcagaggcagca

SEQ ID NO: 1966 - DNA, 20 bp, Zea mays
ggcagcaagcagaggcagca

SEQ ID NO: 1967 - DNA, 19 bp, Zea mays
ggcagaaagcgaggcagca

SEQ ID NO: 1968 - DNA, 20 bp, Zea mays
ggcagcaagcagaggcagca

SEQ ID NO: 1969 - DNA, 21 bp, Zea mays
tggaaggggcatgcagaggag

SEQ ID NO: 1970 - DNA, 640 bp, Zea mays; identical to SEQ ID NO: 1117

SEQ ID NO: 1971 - DNA, 642 bp, Artificial sequence
  Synthetic construct
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaaggatcctctgcatctagccccttccacaattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 1972 - DNA, 14 bp, Glycine max
cccccgcagccccc

SEQ ID NO: 1973 - DNA, 12 bp, Hordeum vulgare
ccccgcagcccc

SEQ ID NO: 1974 - DNA, 11 bp, Hordeum vulgare
cccgcgcccca

SEQ ID NO: 1975 - DNA, 14 bp, Hordeum vulgare
ccccgcgcccccca

SEQ ID NO: 1976 - DNA, 14 bp, Oryza sativa
ccccgcagcccgcc

SEQ ID NO: 1977 - DNA, 16 bp, Oryza sativa
ccccagcagcccacca

SEQ ID NO: 1978 - DNA, 12 bp, Oryza sativa
cccgcgccccca

SEQ ID NO: 1979 - DNA, 13 bp, Oryza sativa
accggcagcccca

SEQ ID NO: 1980 - DNA, 12 bp, Oryza sativa
cccgcgccccca

SEQ ID NO: 1981 - DNA, 14 bp, Oryza sativa
ccccgcgcccccca

SEQ ID NO: 1982 - DNA, 12 bp, Oryza sativa
acggcagcccca

SEQ ID NO: 1983 - DNA, 13 bp, Sorghum bicolor
ccccgcagccccc

SEQ ID NO: 1984 - DNA, 14 bp, Triticum aestivum
ccccgcgcccccca

SEQ ID NO: 1985 - DNA, 12 bp, Triticum aestivum
ccccgcagcccc

SEQ ID NO: 1986 - DNA, 15 bp, Triticum aestivum
ccccagcagccgcca

SEQ ID NO: 1987 - DNA, 14 bp, Triticum aestivum
cccccgcggccccc

SEQ ID NO: 1988 - DNA, 14 bp, Triticum aestivum
cccggcggccccca

SEQ ID NO: 1989 - DNA, 14 bp, Triticum aestivum
cccggcggccccca

SEQ ID NO: 1990 - DNA, 14 bp, Triticum aestivum
ccccgcgcccccca

SEQ ID NO: 1991 - DNA, 13 bp, Zea mays
ccccgcagccccc

SEQ ID NO: 1992 - DNA, 14 bp, Zea mays
ccccgcggccccag

SEQ ID NO: 1993 - DNA, 15 bp, Zea mays
ccgcgcagcccccga

SEQ ID NO: 1994 - DNA, 13 bp, Zea mays
ccccgcagccccc

SEQ ID NO: 1995 - DNA, 21 bp, Zea mays
ttagatgaccatcagcaaaca

SEQ ID NO: 1996 - DNA, 11 bp, Arabidopsis thaliana
gggaggcacaa

SEQ ID NO: 1997 - DNA, 13 bp, Arabidopsis thaliana
aacggaggcacaa

SEQ ID NO: 1998 - DNA, 13 bp, Arabidopsis thaliana
aacggaggcacaa

SEQ ID NO: 1999 - DNA, 12 bp, Brassica napus
gaggaggcacaa

SEQ ID NO: 2000 - DNA, 12 bp, Brassica rapa
gaggaggcacaa

SEQ ID NO: 2001 - DNA, 12 bp, Brassica oleracea
agggaggcacaa

SEQ ID NO: 2002 - DNA, 12 bp, Oryza sativa
gaggaggcacaa

SEQ ID NO: 2003 - DNA, 12 bp, Oryza sativa
aggcgagcacaa

SEQ ID NO: 2004 - DNA, 12 bp, Zea mays
cggcgagcacaa

SEQ ID NO: 2005 - DNA, 12 bp, Zea mays
cggcgagcacaa

SEQ ID NO: 2006 - DNA, 408 bp, Artificial sequence
  Synthetic construct
ggcagagccgtgcccgtctcatcccctgcccgtgcaagcagctaggtaggacgatttgagcgtggtgttaggccgaaccgctgaaggaagattgctccactgttgactgcattaatacgtttcgagactccagaaatgtattgcttatattcagcaatataatgttcctggagtctaacaatgtattaatatagtcgatagtggaagaacggtaacatatgtggtttgcagcaggtgagcaggatgggtgtggatgattgaatatctctgttcagtgttttcatcatctgactgaacactgaatcagcttgctgacgttagaggtttcagtttacctaatttatggtctgtacccatgaaaagtgggaaaaggctgaagaattcgatttctttctttctttcaatgtt

SEQ ID NO: 2007 - DNA, 408 bp, Artificial sequence
  Synthetic construct
ggcagagccgtgcccgtctcatcccctgcccgtgcaagcagctaggtaggacgatttgagcgtggtgttaggccgaaccgctgaaggaagattgctccactgttgactgcattaattctgccctatgtctctcaaatgtattgcttatattcagcaatataatgttcgagagacatcacgcggaattaatatagtcgatagtggaagaacggtaacatatgtggtttgcagcaggtgagcaggatgggtgtggatgattgaatatctctgttcagtgttttcatcatctgactgaacactgaatcagcttgctgacgttagaggtttcagtttacctaatttatggtctgtacccatgaaaagtgggaaaaggctgaagaattcgatttctttctttctttcaatgtt

SEQ ID NO: 2008 - DNA, 408 bp, Artificial sequence
  Synthetic construct
ggcagagccgtgcccgtctcatcccctgcccgtgcaagcagctaggtaggacgatttgagcgtggtgttaggccgaaccgctgaaggaagattgctccactgttgactgcattattccatcacactctgacggaaatgtattgcttatattcagcaatataatgttcccgtcagagaacgatggagtaatatagtcgatagtggaagaacggtaacatatgtggtttgcagcaggtgagcaggatgggtgtggatgattgaatatctctgttcagtgttttcatcatctgactgaacactgaatcagcttgctgacgttagaggtttcagtttacctaatttatggtctgtacccatgaaaagtgggaaaaggctgaagaattcgatttctttctttctttcaatgtt

SEQ ID NO: 2009 - DNA, 2082 bp, Zea mays
atgggcgactcctcggtggccggcgcgctcgtgccgtctgtgcccaagccggagcccgcgccgtccggtgacacctccgcggcggccgcggcgactacagcggcgctggcgatgccggaggaggcgggtatgcgcgcggcgtcggcgtcgcctcaggggcctgcggaggagggggagggccccgccgatagggaccttctctgcccgatctgcatggccgtcatcaaggacgccttcctcaccgcatgcggccacagcttctgctacatgtgcatcgtcacgcatctcagcaacaagagcgactgcccctgctgcggccactaccttaccaaggcccagctctaccccaactttctccttgacaaggttctgaagaaaatatcagcccaacaaatagcaaaaacagcatcgccgatcgatcaatttcgatgtgcattgcaacagggaaatgaaatgggggttaaagagttggatagccttatgactttgattgctgagaagaagcggcaaatggaacaacaagaatcagagacaaatatgcaaatattgctagtcttcttacactgccttagaaagcaaaagctagaagagttgaatgagattcaaactgatctacaatacatcaaagaggatataagttctgtggagagacatagggcagaattatatcgcacaaaagaaaggtactccatgaagctgcgcatgcttttagatgagcctactgcgcaaaaaatgtggccctctcctatagacaaagctagctgtcgctttcttcccaactctcggacaccacttagtggatcatgtccaggaactttacagaataagaagcttgatttgaaagctcaagtaagccatcaaggatttcaaaggagagatgctctaacttcttctgatcctcctaactcccctatacaatcgggtaatgttattgctaggaagaggcgagttcaagcacagttcaatgagcttcaagaatactacctgcaaagacgtcgtactggagcacaggcacgcagacaggaagaaagagatatagttgcaatgaatagagaaggctatcatgcaggtcttcaggatttccagtctgtgctaacaacgttcactcgatacagtcgtctacgtgtcattgcggaactaagacatggagacttgtttcactctgccaatattgtatccagtattgaatttgatcgtgatgatgaactatttgctaccgctggagtctcgaaacgtattaaagtcttcgaattttccactgttgttaatgaaccatcagatgtgcattgcccagttgttgaaatggctaccagatctaaacttagctgcctaagctggaacaagtactcaaaaaatattattgcaagcagtgactatgagggtatagtaactgtgtgggatgttcagacccgtcagagtgtgatggaatatgaagagcatgagaagagagcatggagtgttgatttttctcgcacagactcttcaatgctagtatctgggagtgatgattgcaaggtgaaagtgtggtgcacaaatcaagaagcaagtgtgatcaatattgatatgaaagcaaatatttgctcggttaaatataatcctggatcaagcttctacgttgcagtcggatctgctgatcaccatattcattactttgatttacgtaatccaagttcgcctgtccatattttcggggggcacaagaaagcagtatcatatgtgaaattcttatctaacaatgagcttgcgtctgcatcaacagatagcacattacgcttatgggatgtcaaggataactgcccggtacggacattcagaggacacaaaaatgaaaagaactttgttggcttgtctgtgaacaatgaatatattgcttgtggaagtgagacaaatgaggtttttgtttatcacaaggctatctcgaaaccggcagcaagccatagatttgtatcttctgacccggatgatgccgatgatgatcctggttcttatttcattagtgctgtctgctggaagagtgatagccctacgatgttaactgctaacagtcaggggaccataaaagttcttgtacttgctccttga

SEQ ID NO: 2010 - DNA, 408 bp, Artificial sequence
  Synthetic construct
ggcagagccgtgcccgtctcatcccctgcccgtgcaagcagctaggtaggacgatttgagcgtggtgttaggccgaaccgctgaaggaagattgctccactgttgactgcatttgtctgccagcttggtccggaaatgtattgcttatattcagcaatataatgttcccggaccaaaacggtagataaatatagtcgatagtggaagaacggtaacatatgtggtttgcagcaggtgagcaggatgggtgtggatgattgaatatctctgttcagtgttttcatcatctgactgaacactgaatcagcttgctgacgttagaggtttcagtttacctaatttatggtctgtacccatgaaaagtgggaaaaggctgaagaattcgatttctttctttctttcaatgtt

SEQ ID NO: 2011 - DNA, 1002 bp, Zea mays
atggtggtcctcaccaagggcgagctggagcagatcgcgctgccggccgtgcagcgcgcatcgccgccgccgccggccgccgtgccggaggtcgacctggcagccggggacgccgccgccgccgcgcgcgcggtggccaaggcgtgcgaggaccacggcttcttcaaggtgacgggccacggcgtgccgccgcacctcctggcgcgcctcgaggccgccgcggccgcgttcttcgcgctcccgcagcgggagaaggacagggccgccggctgcccgttcggatacgccagcaagcggattggcgccaacggcgatctcggctgggtcgagtacctcctgcttgccgtcaccgccgccggcgcagcggccgcgccggggtctgcgtgcgagggcgcggagccgtcctgtttccgtgctgtgctggacgagtacgtggcggcggtgaggcgcatgacctgcacggtgctgcagctgatggcgcaggggctgggcctcgacgacagggacgtgttcagccggctggtgctggaccgggacagcgactccatgctgagggtgaaccactacccgccagcggcggagacgaggcggctgacggggttcggcgagcacaccgacccgcagatcatctccgtcctccgctccaacgacgcgtccggcctcgagatcacgctgcgggacggcacctgggtgtccgtgccctccgacacggaatccttcttcgtcaatgtcggcgacgcgttgcaggtgctgaccaacgggcggttccggagcgtgcggcaccgggtgatggtgagcagcgcgcggccgcgggtgtcggtgatcttcttcggcggcccgccgccgcgggagcgcctggcgccgctgccgggtctggtggaccgggagggcggccgacgccgctacagggagttcacgtggagggagtacaagaactcggcgtaccggaccaagctggcagacaacaggctctgctccttcgagaccatggcgacgagctag

SEQ ID NO: 2012 - DNA, 408 bp, Artificial sequence
  Synthetic construct
ggcagagccgtgcccgtctcatcccctgcccgtgcaagcagctaggtaggacgatttgagcgtggtgttaggccgaaccgctgaaggaagattgctccactgttgactgcatttgatgaccatggcgcctgggaaatgtattgcttatattcagcaatataatgttccccaggcgcaacggtcattaaatatagtcgatagtggaagaacggtaacatatgtggtttgcagcaggtgagcaggatgggtgtggatgattgaatatctctgttcagtgttttcatcatctgactgaacactgaatcagcttgctgacgttagaggtttcagtttacctaatttatggtctgtacccatgaaaagtgggaaaaggctgaagaattcgatttctttctttctttcaatgtt

SEQ ID NO: 2013 - DNA, 891 bp, Zea mays
atggacgccagcccgaccccaccgctccccctccgcgccccaactcccagcattgacctccccgctggcaaggacagggccgacgcggcggctaacaaggccgcggctgtgttcgacctgcgccgggagcccaagatcccggagccattcctgtggccgcacgaagaggcgcggccgacctcggccgcggagctggaggtgccggtggtggacgtgggcgtgctgcgcaatggcgacggcgcggggctccgccgcgccgcggcgcaagtggcggcggcgtgcgcgacgcacgggttcttccaggtgtgcgggcacggcgtggacgcggcgctggggcgcgccgcgctggacggcgccagcgacttcttccggctgccgctggctgagaagcagcgggcccggcgcgtccccggcaccgtgtccgggtacacgagcgcgcacgccgaccggttcgcgtccaagctcccctggaaggagaccctgtccttcggcttccacgacggcgccgcggcgcccgtcgtcgtggactacttcaccggcaccctcggccaagatttcgagccagtggggcgggtgtaccagaggtactgcgaggagatgaaggagctgtcgctgacgatcatggagctgctggagctgagcctgggcgtggagcgcggctactaccgggagttcttcgaggacagccgctccatcatgcggtgcaactactacccgccgtgcccggtgccggagcgcacgctgggcacgggcccgcactgcgaccccacggcgctgaccatcctcctgcaggacgacgtcggcgggctggaggtcctggtggacggcgagtggcgccccgtccggcccgtcccaggcgccatggtcatcaacatcggcgacaccttcatg

SEQ ID NO: 2014 - DNA, 408 bp, Artificial sequence
  Synthetic construct
ggcagagccgtgcccgtctcatcccctgcccgtgcaagcagctaggtaggacgatttgagcgtggtgttaggccgaaccgctgaaggaagattgctccactgttgactgcattgcttcagcttcgtcctggcgaaatgtattgcttatattcagcaatataatgttccgccaggacaacgctgaagcaatatagtcgatagtggaagaacggtaacatatgtggtttgcagcaggtgagcaggatgggtgtggatgattgaatatctctgttcagtgttttcatcatctgactgaacactgaatcagcttgctgacgttagaggtttcagtttacctaatttatggtctgtacccatgaaaagtgggaaaaggctgaagaattcgatttctttctttctttcaatgtt

SEQ ID NO: 2015 - DNA, 681 bp, Zea mays
atggagagggtcgaggacttagggctcagcctcagcctcagctcgtccctcgcgtctcctcgcactcaccatgtcgccaccatgctgctacgcgctccagagaagaggttcctggagatgccactgctgctgcccgcgaagcggacgaccgaggtcaccggcgaggatggcctgcgaggcggcagcgatgaggaggacggcggctgcggcatcgacggctccaggaagaagctccggctgtccaaggaccagtccgcggtgctcgaggatagcttccgggagcacccaactctcaaccctcggcagaaggcagccttggcgcagcagctaggcctgcggccccgccaggtggaggtgtggttccagaacaggcgcgccaggacgaagctgaagcagacggaggtggactgcgagtacctgaagcgctgctgcgagacgctgacggaggagaaccggcggctgcagaaggaggtgcaggagctccgcgcgctcaagctcgtgtcgccgcacctctacatgcacatgtccccgcccaccaccctcaccatgtgcccctcctgcgagcgcgtctcctcgtccaacggcaactccgcagctgccacggcggccgcgcgcgcgcgcgccggcgccggcgccggcgccatcgtctgccacccgatcgaccgagccactagtacgtag

SEQ ID NO: 2016 - DNA, 408 bp, Artificial sequence
  Synthetic construct
ggcagagccgtgcccgtctcatcccctgcccgtgcaagcagctaggtaggacgatttgagcgtggtgttaggccgaaccgctgaaggaagattgctccactgttgactgcatttctctggagcgcgtagcagcaaatgtattgcttatattcagcaatataatgttcgctgctacgaagtctagagaaatatagtcgatagtggaagaacggtaacatatgtggtttgcagcaggtgagcaggatgggtgtggatgattgaatatctctgttcagtgttttcatcatctgactgaacactgaatcagcttgctgacgttagaggtttcagtttacctaatttatggtctgtacccatgaaaagtgggaaaaggctgaagaattcgatttctttctttctttcaatgtt

SEQ ID NO: 2017 - DNA, 681 bp, Zea mays; identical to SEQ ID NO: 2015

SEQ ID NO: 2018 - DNA, 408 bp, Artificial sequence
  Synthetic construct
ggcagagccgtgcccgtctcatcccctgcccgtgcaagcagctaggtaggacgatttgagcgtggtgttaggccgaaccgctgaaggaagattgctccactgttgactgcatttcttgctgctactctctgctaaatgtattgcttatattcagcaatataatgttcagcagagagaaccagcaagaaatatagtcgatagtggaagaacggtaacatatgtggtttgcagcaggtgagcaggatgggtgtggatgattgaatatctctgttcagtgttttcatcatctgactgaacactgaatcagcttgctgacgttagaggtttcagtttacctaatttatggtctgtacccatgaaaagtgggaaaaggctgaagaattcgatttctttctttctttcaatgtt

SEQ ID NO: 2019 - DNA, 1411 bp, Zea mays
cgatcgatcgagatatcgtgtcaacgtgccggccggggcgtgggaagatgatgaacctatcggctgccgccaacggccgcgacgagttccccccctacgtcgtgccgtccaacgcggccgctccgcccccttccctgctcccaaccatggagcagcagcaggagagcagcatccacagggagcatcatcagctgctgggctacaacctcgaggccaactcgctggccctcctgcccccgtccaacgccgccgccgcccaccaccacaccaccttcgccggcggccacagcccccacgacatcctccacttctacacacctcctccttccgccgcctcgcactacctcgccgccgccgccggcaacccctacagccacttagtctccgcgcccgggaccaccttccaccagacctcgtcgtcctactacccgcccgcggcggcggcgcaggccgcgcccgagtactacttccccaccctcgtcagctccgccgaggagaacatggccagcttcgccgccacgcagctcggcctcaacctcggctaccgcacctacttcccgcccagaggaggctacacgtacggccaccacccgccgcgctgccaggccgagggctgcaaggccgacctctccagcgccaagcgataccaccgtcgccacaaggtgtgcgagcaccactccaaggcgcccgtcgtcgtcaccgccggtggactgcatcagaggttctgccagcagtgcagcagattccatctgctggatgagttcgacgatgctaagaagagctgcaggaaacgcctagcggaccacaaccgccgccgccggaagtcaaagccatcggatgctgatgccggagacaagaaaagggcacatgcgaacaaagcagctgcagctaaagacaaagcagagagtagcagcaagaacatggatatcggagatgggttaggcgcacagatactgggaagtgcactcttgtccaaggaacaagatcaaaccatggatcttggagaggtggtgaaagaagcagtggatcccaaggggaaggcatcaatgcaacagcattacggcttccccttccattcgtcgtcagcaggatcttgcttcccccagacccaagccgtctccagtgataccacatccaatataggtcaagtgcaagagccaagcttagggttccaccatcagcaccaccaacacagcaacatcttgcagctcggccaggctatgtttgatctcgacttcgatcactagtcaatatgtgatgcacatgcaccctctctttctcaccccaccccacccctcccctcccctctatcttgtttgtgcgcgtaatccgaatatttttcctttttaaattatctgtgttaattactgtaacgtggacataataatgatagtctatgcttgccatgcaa

SEQ ID NO: 2020 - DNA, 21 bp, Glycine max
ttagatgaccatcagcaaaca

SEQ ID NO: 2021 - DNA, 2836 bp, Zea mays; identical to SEQ ID NO: 1096

SEQ ID NO: 2022 - DNA, 642 bp, Artificial sequence
  Synthetic construct
cctcaaagaggcagccatggctccacataaaagcgcccaatgggagctccctcttctccccccacgcccctccccctcttgataagcccacgtcggcggcagggggggcggccgccaggcttgctatagctggtccatggcaccatacatgtaagcacgcacacaggcacacacacacacgcacgcaatgatctacgtatctagcagcagcttatcatgtcgtcatcatgcatgcatggccgacggaggtcgtcatcttatctgggagcgtgtgtgtcttggcaatgggaagctgcatgcgcctctcgggcgtcggcgcgtcggcgcctagctgtagggcggcgtgccatagagctgcctcctgccgctcacaccatgctgttgacgaggactgatggtggccatggcctctcggcgtcggtggcggcggcgccggcgccgagttttacctctctactaaggcgtttgctgatctaggtcatctaacaattgttctcatctatctgggtctgtctgttggctgcccggtgacggtatacggtgatgttctaatagtactcaattggtcttggatcggagttcatgctacggctcctctgttatatattacacggctgacggctcctccttattaatgtgtac

SEQ ID NO: 2023 - DNA, 489 bp, Artificial sequence
  Synthetic construct
gcatctgctgttctttatttctatacatacatatatactatcatcggttatttgcttctctattctgtccgagtactttacggtgttccgcacatagatctcgtggccggctgttttgcgctttcgcttgcgtttcttggccctgctggtgttgaccggtccgaacgggggcagatcgatgctttgggtttgaagcgggatgcagatccgatttatgaagggtcgttccgaagggctggttccgctgctcgttcatggttcccactatcctatctcatcatgtgtatatatgtaatccatgggggagggtttctctcgtctttgagataggcttgtggtttgcatgaccgaggagctgcaccgcccccttgctggccgctcttaaataggaattgcatcctgcatcctgatccacccctccatttttttttgcttgttgtgtccttcctgggacctgagatctgaggctcgtggtggctcactgtagat

SEQ ID NO: 2024 - DNA, 2811 bp, Zea mays
ccaccactccgccatcattcccccgctcggcccgcgaaaccgtaccctgagaccactccctccgccgccatgccggacctcccctgcgacggcgatggcgtctgcatggtctgccgcgtcacctccccgccggaggtcgacctcctccattgctccacctgcgccacgccctggcactccccgtgcctctccaaggctcccgccctggccgacgccgccagctggagctgccccgactgctccctggactccgccaccgtcgccgctccctcggcccctgctaacaccctcgttgccgccatccgcgccatcgagtccgacaacaccctctccgaccaggagaaggcgcgccgccgccaggccctcctcgccggcgacgcccccgacgtcgcggacgacgacgacgcggccgacgataccctcgaaatcgtcggcaaaaacttcagctgcgttttctgcatgaagctccctgaacgacccgtcaccacaccatgtgggcataacttctgcttgaaatgcttccagaagtggattcaaagcaagaagagaacctgtgggaaatgtcgggcaccgatccctgccaaaatggccgagcagccaagaatcaactctgcgctagttgaagttatcaggatggctaagatttcaaagaatcataactctgctggctcagctgttccataccactatatgcgaaatgatgataggcctgataaggcatttacaactgacagagctaagaaggctggaaaagcaaacgcatcgagtggccagatctttgtgaccattgcacctgatcattttggccctatacttgcagaaaatgacccccgcaggaatatgggtgttcgagtcggggaaacgtgggaggacaggcttgagtgcaggcaatggggtgctcactttcctcatgtggctggtattgccggccagtctacgcatggggctcaatcagtagccctctccggagggtatgaagatgatgaagaccatggggagtggtttctttacactggaagcggcgggagggacctaagtggtaacaagcgaacaaacaaggagcagtcatctgatcagaaatttgagaagctgaatgctgctttacgcattagttgcttgaagggctaccctgttagggttgtacggtcgcacaaagagaagcgatcctcgtatgctcctgaatctggtgtgaggtatgatggggtttacagaattgagaagtgttggaggaagattggtattcagggtaagttcaaggtctgcaggtatctctttgtacgctgtgacaatgaaccagctccttggaccagcgatgatcatggtgaccgtccgagacccttgccaaagataaaggagctacaaggtgcaactgatataacagagaggaaagggcgtccttcatgggattatgatgagaaagatggctggaaatggatggtgcctccgccagtcagcaagaggcctgttctctctggtgatcctgagaccgacaagctaatccggaaagcaacaaagcgtgctcatttatctgttgctgaaaggctgcttaaagagtttggttgttctatctgccgggcggtgattaaagagccacttacaacaccatgtgctcacaacttctgcaagacttgtttgcttggtgcatatgatagccagtcctctatgagggaaagaagccgtggtggtcggactctaagggcacagaagattgtgaagacgtgcccttcctgccctactgacatctgcgacttcttagaaaatccccagatcaaccgagaaatgatggagttgattgagtccttgcaacgcaaggctgttgaagaaggcaagatggctgcaggtgatgccgaggaatctggtgatggtgactcggaggaaaatggtggtgctttggtgaagggagaagatgatagcaatttgaacgaggaaggtcaagacggtgtagacgctgatggttctgtgaagattgtggttgaaatggagggtgcaaaagatgataaaaagtcaaagatgggcgcggctgaagtggtggatgtgttagttgaagatgctgctgcgaaacagccgaagaagcgcacggctgatgaagatgctgctgcgaaacagacgaagcacaaggctgatgctgagactggtggcaagagggtgaagagcagtgctgcagtggaagaggttgatgtgtgcgtcactcctatgaaacggaccaggaagagtggtgatatgcatgatgacggcaacggcagccctgctgtgagcagcggccgcagggtgactcggagcagtgtgaatgccacgggagctgatgacagtccagcgaggaggaccagaagccgtggcagagcatgctgaaggtagtgggtgctgggcgccctcttttttgggtgtggaacctttgctgtgcgcagtgttgcagccatttcttttggtttgggggagaccgacctgctacaggtattccccatgcttctttcttccaggatgcaattcctatttaatttcaaggtagctgctgcactcgatctgcgagatgcaattttgttaactggcagccaggtgttggcttacgccatgattttggcacaacaggttcctagagagaaacaagatagctgatgttcttgcaaaaaaaaagcaagacgggcaactaccccaaatccatgccttttctctaggggcttcattctccaacctgtaatatctagcatgtgttttgaaacttggattgttcggggcaacatgaccccccatctttgtaacatgtttatgatgtaataaatcttgaattgaaaaaaaagagaggacatggaatga

SEQ ID NO: 2025 - DNA, 383 bp, Artificial sequence
  Synthetic construct
cgaagagctgggaacgggagattggagcaatcagaatttgtgctgggggtacgaggaggaagcaatgtgtgctggtgcaatgcatttaatttcttcctcctctatacccccagtatgatttctgatgattctttcctttccttttgctttttgcaatacgcaatatgcatgtaccttatttttcattccatcctcattattctatgctaatggatagtacttccttcttctccatgtttcttttattgttataacaacacatgataaaattgtaatatgaaacataacttctgcagcctaatttgtttttttcgtgcatttgataaacggcgttggagaaggagtttatgttgtcatatgaattaaagggaagcacttttaaa

SEQ ID NO: 2026 - DNA, 1505 bp, Zea mays
aggctgctgtctcacggctgcggctgcggcggttcgggctccagactccagggatggccgccggtgcgggaggcggcgaactggaggcgctggagggcgtgcgctccatcgtgctcaagccgtcggagtcgctcgacgagtcgcgtttcacgaggatcgccggcgccgacttcaacgacccggccatcggactccaggggctgctcgcctcgctcgcgtccaccgggttccaggcatccaacctcggcgacgccatcgacgtcgtcaaccagatgttagactggaggttgtcgcatgagaagcccagcgaggattgtgatgaagctgaacttgaccctaaatatagagcatctgtgaagtgcaagatatttctgggcttcacctcgaacctcgtgtcttctggcatccgggatataatccgttttctagctcagcatcacatggtggatgttattgttacaagtgctgggggtatagaggaggatctcattaaatgccttgcaccaacttacagaggcgatttttctttacctggagcactgctgcggtcaaaaggactgaaccggataggaaatctgttggtgcccaatgacaactattgcaagtttgagaactggatcatgccactcttcgaccagatgctacaggagcaatctactgagaatgtttggacaccgtcgaaggtgatagcgcgccttggcaaagaaataaatgatgaaagctcctatctttattgggcatacaagaataacatccctgtatactgcccagcattgactgatggatcacttggagacatgctgttctgtcatgcagttcgtaatcctggccttattattgacattgtacaagatatacggctgatgaatggggaagccatccatgcaacaccaaggaagacagggattatagttcttggtggaggccttccaaagcatcatatatgcaatgccaatatgttccgcaatggtgcagattatgctgtctatattaacacggctcaagagtttgatggtagcgattctggagcacaccccgatgaagcagtctcatggggcaagatcaagggttcagcaaaacctgtaaaggtgcattgcgatgcaagtatcgctttcccgcttcttgttgcagcaacatttgcacgtaaggttcataactccaaatgaacagactgaatcggattcggtggagtgaatgggcaacagaattttgttgaactctccaaatgaccttttggagcacgaggtctacttcacctgcacagggatcatgtgcaagttttttcggtgactcgcggcaaccacatgccatcattattcgatgttcacttgatgctgtactagctggttgatagcatttttgttacaactgataatttattgaaatacagacatacgattgttcatccgagtcgtctgcttacgaattttttgtagacgaaacatctgcttacgaaattgacaaatggcctgttttatgaacacattttttttcacctgaaaaaa

SEQ ID NO: 2027 - DNA, 386 bp, Artificial sequence
  Synthetic construct
cgaagagctgggaacgggagattggagcaatcagaatttgtcctgggggtaagagaagacagcaatgtgtgctggtgcaatgcatttaatttctgtcttctccgtacccccaggatgatttctgatgattctttcctttccttttgctttttgcaatacgcaatatgcatgtaccttatttttcattccatcctcattattctatgctaatggatagtacttccttcttctccatgtttcttttattgttataacaacacatgataaaattgtaatatgaaacataacttctgcagcctaatttgtttttttcgtgcatttgataaacggcgttggagaaggagtttatgttgtcatatgaattaaagggaagcacttttaaatag

SEQ ID NO: 2028 - DNA, 1505 bp, Zea mays; identical to SEQ ID NO: 2026

SEQ ID NO: 2029 - DNA, 386 bp, Artificial sequence
  Synthetic construct
cgaagagctgggaacgggagattggagcaatcagaatttgtggtggtggtacgaggaggaagcaatgtgtgctggtgcaatgcatttaatttcttcctcctctataccaccactatgatttctgatgattctttcctttccttttgctttttgcaatacgcaatatgcatgtaccttatttttcattccatcctcattattctatgctaatggatagtacttccttcttctccatgtttcttttattgttataacaacacatgataaaattgtaatatgaaacataacttctgcagcctaatttgtttttttcgtgcatttgataaacggcgttggagaaggagtttatgttgtcatatgaattaaagggaagcacttttaaatag

SEQ ID NO: 2030 - DNA, 1505 bp, Zea mays; identical to SEQ ID NO: 2026

SEQ ID NO: 2031 - DNA, 383 bp, Artificial sequence
  Synthetic construct
cgaagagctgggaacgggagattggagcaatcagaatttgtgctgggggtacgaggaggaagcaatgtgtgctggtgcaatgcatttaatttcttcctcctccatacccccagtatgatttctgatgattctttcctttccttttgctttttgcaatacgcaatatgcatgtaccttatttttcattccatcctcattattctatgctaatggatagtacttccttcttctccatgtttcttttattgttataacaacacatgataaaattgtaatatgaaacataacttctgcagcctaatttgtttttttcgtgcatttgataaacggcgttggagaaggagtttatgttgtcatatgaattaaagggaagcacttttaaa

SEQ ID NO: 2032 - DNA, 1505 bp, Zea mays; identical to SEQ ID NO: 2026

SEQ ID NO: 2033 - DNA, 711 bp, Artificial sequence
  Synthetic construct
gataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctggtttctcataccagaattaacgttcctcctctatacccccagttacgtgcaaatgttgctgcactactaccgtggcctctgcgtctgaaagtacagcatgtcgccattcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagtt

SEQ ID NO: 2034 - DNA, 1505 bp, Zea mays; identical to SEQ ID NO: 2026

SEQ ID NO: 2035 - DNA, 792 bp, Artificial sequence
  Synthetic construct
gataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctggtttctcataccagaattaacgttcctcctctatacccccagttacgtgcaaatgttgctgcactactaccgtggcctctgcgtctgaaagtacagcatgtcgccattcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttaaaaaaaaaaaagttcagttaatgttttcacccctgtggatgctctgcaatacatgaacatacatagcaaaaag

SEQ ID NO: 2036 - DNA, 1505 bp, Zea mays; identical to SEQ ID NO: 2026

SEQ ID NO: 2037 - DNA, 383 bp, Artificial sequence; identical to SEQ ID NO: 2031
  Synthetic construct

SEQ ID NO: 2038 - DNA, 1505 bp, Zea mays; identical to SEQ ID NO: 2026

SEQ ID NO: 2039 - DNA, 990 bp, Artificial sequence
  Synthetic construct
aaacctaaacctaaacggctaatcccgacgtcaaataccaaaaagagaaaaacaagagcgccgtcaagctctgcaaatacgatctgtaagtccatcttaacacaaaagtgagatgggttcttagatcatgttccgccgttagatcgagtcatggtcttgtctcatagaaaggtactttcgtttacttcttttgagtatcgagtagagcgtcgtctatagttagtttgagattgcgtttgtcagaagttaggttcaatgtcccggtccaattttcaccagccatgtgtcagtttcgttccttcccgtcctcttctttgatttcgttgggttacggatgttttcgagatgaaacagcattgttttgttgtgcacgtgccctacttctccatagaccatttattcctcctctatacccccagttacgtgcaaatgttgctgcactactaccgtggcctctgcgtctgaaagtacagcatgtcgccaatattccaggatatgcaaaagaaaacaatgaatattgttttgaatgtgttcaagtaaatgagattttcaagtcgtctaaagaacagttgctaatacagttacttatttcaataaataattggttctaataatacaaaacatattcgaggatatgcagaaaaaaagatgtttgttattttgaaaagcttgagtagtttctctccgaggtgtagcgaagaagcatcatctactttgtaatgtaattttctttatgttttcactttgtaattttatttgtgttaatgtaccatggccgatatcggttttattgaaagaaaatttatgttacttctgttttggctttgcaatcagttatgctagttttcttataccctttcgtaagcttcctaaggaatcgttcattgatttccactgcttcattgtatattaaaactttacaactgtatcgaccatcatataattctgggtcaagagatgaaaatagaacaccacatcgtaaagtgaaat

SEQ ID NO: 2040 - DNA, 1505 bp, Zea mays; identical to SEQ ID NO: 2026

SEQ ID NO: 2041 - DNA, 990 bp, Artificial sequence
  Synthetic construct
aaacctaaacctaaacggctaatcccgacgtcaaataccaaaaagagaaaaacaagagcgccgtcaagctctgcaaatacgatctgtaagtccatcttaacacaaaagtgagatgggttcttagatcatgttccgccgttagatcgagtcatggtcttgtctcatagaaaggtactttcgtttacttcttttgagtatcgagtagagcgtcgtctatagttagtttgagattgcgtttgtcagaagttaggttcaatgtcccggtccaattttcaccagccatgtgtcagtttcgttccttcccgtcctcttctttgatttcgttgggttacggatgttttcgagatgaaacagcattgttttgttgtgatttttctctacaagcgaatagaccatttattcctcctctatacccccagttacgtgcaaatgttgctgcactactaccgtggcctctgcgtctgaaagtacagcatgtcgccaatattccaggatatgcaaaagaaaacaatgaatattgttttgaatgtgttcaagtaaatgagattttcaagtcgtctaaagaacagttgctaatacagttacttatttcaataaataattggttctaataatacaaaacatattcgaggatatgcagaaaaaaagatgtttgttattttgaaaagcttgagtagtttctctccgaggtgtagcgaagaagcatcatctactttgtaatgtaattttctttatgttttcactttgtaattttatttgtgttaatgtaccatggccgatatcggttttattgaaagaaaatttatgttacttctgttttggctttgcaatcagttatgctagttttcttataccctttcgtaagcttcctaaggaatcgttcattgatttccactgcttcattgtatattaaaactttacaactgtatcgaccatcatataattctgggtcaagagatgaaaatagaacaccacatcgtaaagtgaaat

SEQ ID NO: 2042 - DNA, 1505 bp, Zea mays; identical to SEQ ID NO: 2026

SEQ ID NO: 2043 - DNA, 408 bp, Artificial sequence
  Synthetic construct
ggcagagccgtgcccgtctcatcccctgcccgtgcaagcagctaggtaggacgatttgagcgtggtgttaggccgaaccgctgaaggaagattgctccactgttgactgcattgcaaattgacagcaccgcctaaatgtattgcttatattcagcaatataatgttcaggcggtgcaaccagtttgcaatatagtcgatagtggaagaacggtaacatatgtggtttgcagcaggtgagcaggatgggtgtggatgattgaatatctctgttcagtgttttcatcatctgactgaacactgaatcagcttgctgacgttagaggtttcagtttacctaatttatggtctgtacccatgaaaagtgggaaaaggctgaagaattcgatttctttctttctttcaatgtt

SEQ ID NO: 2044 - DNA, 1014 bp, Zea mays
atggcgttattttctcaccaccatctccagcagccacacccgcagcaggcaccgcccccgaatcagcagcagccggtgcttccttccttcaggaacgcgctaccggtgcctgtggatggccagatcccagcgcccctcaccttcttcaacccgccgcctgccttcccggagcagcccgcgcagacaacgctggtggatgcggtggggctgacggcagctgctgggcttgggtggaggcagccgagggagcaggaactgcttggagaaaactcccagatgtcgtccatcgattttctgcagacgggctcggcggtatcgacggggctggcgctgtctctggaggaccggcgccacggcggcggcggggctgggaactcctccggcgattcaccgctgctcctgctgcccatgctggacgatgacatttcacgcgaggtccagcggcttgacgctgatatggaccgcttcattaaagctcagagtgaacggctgaggcaatctatactggagaaagttcaggcaaagcaatttgaggcactggcctcagttgaggacaagatattcagaaaaatacgggataaagaggcggaagtggaaaccatcaacaaaaggaactctgaactagaggaccagattaagcatttgggagtggaagttggtgcttggcagcaaagggccaagtacaatgagagcctgatcaatgcactcaagtacaacttggaacaagtatgtgctcaccagagcaaggacttcaaggaaggctgcggtgatagcgaggtagatgacacggcgtcctgtccctatggtggtgctgtcaatttgcaactgatgccaaaggagaacagacaaccgaagaatttaacggcttgcagggtctgtaaatcaagtgaggcatgcatgctcttgctgccgtgtcggcatctttgtctatgcaaggagtgcgagagcaagctgagcatctgccccctgtgccagtcctccaagatacttggcatggagatatattatgcatag

SEQ ID NO: 2045 - DNA, 485 bp, Zea mays; identical to SEQ ID NO: 1118

SEQ ID NO: 2046 - DNA, 2836 bp, Zea mays; identical to SEQ ID NO: 1096

SEQ ID NO: 2047 - DNA, 408 bp, Artificial sequence
  Synthetic construct
ggcagagccgtgcccgtctcatcccctgcccgtgcaagcagctaggtaggacgatttgagcgtggtgttaggccgaaccgctgaaggaagattgctccactgttgactgcattgttcccgttcccgctcccgtaaatgtattgcttatattcagcaatataatgttcacgggagcgaacacgggagcaatatagtcgatagtggaagaacggtaacatatgtggtttgcagcaggtgagcaggatgggtgtggatgattgaatatctctgttcagtgttttcatcatctgactgaacactgaatcagcttgctgacgttagaggtttcagtttacctaatttatggtctgtacccatgaaaagtgggaaaaggctgaagaattcgatttctttctttctttcaatgtt

SEQ ID NO: 2048 - DNA, 675 bp, Zea mays
gggtccacttctccttcaggcctggagctcaccatggctgtcccgggcctcagctcctcctctggctcagaggggtttggatgcaacaacaacaacgggagcgggaacgggaacaacatgagggacctggacatgaaccagccggcgagcggcggcgaggaggaggagttcccaatggggagcgtggaggaggaggaggacgagcgcggcggcgccggcgggccgcaccgcgccaagaagctccggctgtccaaggagcagtcccgcctcctggaggagagcttccgcctcaaccacaccctcacaccgaagcaaaaggaggccttggctgtcaagctcaagctgcggcccaggcaggtggaggtctggttccagaaccgcagggctaggacgaagcttaagcagacggagctggagtgcgagtacctgaagcgctgcttcggctcgctgaccgaggagaaccggcggctgcagcgggaggtggaggagctgcgcgcgatgcgggtggccccgcccaccgtgctctccccgcacacccggcagccgctcccggcgtccgcgctcaccatgtgcccgcgctgcgagcgcatcaccgccgcaacggccgcgcgcaccccacgcccgccgcccgccgcgagccccttccacccgcgccgcccgtccgcggcgttttag

SEQ ID NO: 2049 - DNA, 408 bp, Artificial sequence
  Synthetic construct
ggcagagccgtgcccgtctcatcccctgcccgtgcaagcagctaggtaggacgatttgagcgtggtgttaggccgaaccgctgaaggaagattgctccactgttgactgcattggttcatgtccaggtccctcaaatgtattgcttatattcagcaatataatgttcgacggacctaaccatgaatcaatatagtcgatagtggaagaacggtaacatatgtggtttgcagcaggtgagcaggatgggtgtggatgattgaatatctctgttcagtgttttcatcatctgactgaacactgaatcagcttgctgacgttagaggtttcagtttacctaatttatggtctgtacccatgaaaagtgggaaaaggctgaagaattcgatttctttctttctttcaatgtt

SEQ ID NO: 2050 - DNA, 675 bp, Zea mays; identical to SEQ ID NO: 2048

SEQ ID NO: 2051 - DNA, 408 bp, Artificial sequence
  Synthetic construct
ggcagagccgtgcccgtctcatcccctgcccgtgcaagcagctaggtaggacgatttgagcgtggtgttaggccgaaccgctgaaggaagattgctccactgttgactgcattcccgccaccgttgttgctgaaaatgtattgcttatattcagcaatataatgttctcagcaacacctgtggcgggaatatagtcgatagtggaagaacggtaacatatgtggtttgcagcaggtgagcaggatgggtgtggatgattgaatatctctgttcagtgttttcatcatctgactgaacactgaatcagcttgctgacgttagaggtttcagtttacctaatttatggtctgtacccatgaaaagtgggaaaaggctgaagaattcgatttctttctttctttcaatgtt

SEQ ID NO: 2052 - DNA, 882 bp, Zea mays
aaaaaggcttgtcgcctgtgatgggggccacttctccttcaggcctggagctcaccatggctgtccccggcctcagctcctcctctggctcagaggggtttgtttgcaacaacaatatcagcaacaacggtggcgggaacatgagggacctggacatgaaccagccggcgagcggcggcgaggaggaggatttcctgatgggcggcgtggaagaggacgaggaggagcggggcgccggcggaccgcaccgcccaaagaagctccgcctctccaaggagcagtcccgcctcctcgaggagagcttccgcctcaaccacaccctctcaccgaagcaaaaggaggccttggcgatcaaactgaagctgcggcccaggcaggtggaggtctggtttcagaaccgcagggcaaggactaagctgaagcacacggagatggagtgcgagtacctgaaacgctgcttcggctcgctgacggaggagaaccgccgcctgcagcgggaggtggaggagctgagggcgatgcgcatggcgccgcccacggtgctctcgccgcacacacgccagccactcccggcgtccgcgctcaccatgtgcccccgctgcgagcgcgtcaccgctgccacctgcccgcggatcacccgcccggccgcctcgccgttccaccctcgccgcccctcagcggcgttttagggtttagttatggtagggcttaagagaaaaggtcgaggtagatttgctagtggtaatgtaggacgcacgatcgataagtctttgtgtaaattgatgatggaggagaaaagaacatggaaaaggcgtagtggggtcgtgtggggtttggaggcgcccccatggaccatttgggctaaaaaaaaaaaaaaaaaaa

SEQ ID NO: 2053 - DNA, 408 bp, Artificial sequence
  Synthetic construct
ggcagagccgtgcccgtctcatcccctgcccgtgcaagcagctaggtaggacgatttgagcgtggtgttaggccgaaccgctgaaggaagattgctccactgttgactgcattcgaacacggggagagggcccaaatgtattgcttatattcagcaatataatgttcgggccctctaatcgtgtttgaatatagtcgatagtggaagaacggtaacatatgtggtttgcagcaggtgagcaggatgggtgtggatgattgaatatctctgttcagtgttttcatcatctgactgaacactgaatcagcttgctgacgttagaggtttcagtttacctaatttatggtctgtacccatgaaaagtgggaaaaggctgaagaattcgatttctttctttctttcaatgtt

SEQ ID NO: 2054 - DNA, 990 bp, Zea mays
atggatattatggcgcttaatgcgagagacgaggagcagtacgggaacaaccatctcgggctcgggctgagcctcagcctcggcctcggcgtcgccaccgcggctccggtcgaggtcgagcccccgccaccgcccgcggcggcggcagcagcagcagcagcgagctatcagcgtcgcgcccatcacctccctccccgcgccgcagtggtggaagtggaacggccccggtctcttcttcgggacgacgatggatccatctctggagaggaaccagcagcagcagcagccggcggccgcgcgccacggccacgagatgccgttcctgcggggggtggacgtgaaccgggcccctgccggggagaccaggaggggtactgcagcgaggacgacgaggagcctggcggcgcgtcgtcgtcgccaaacagcacgctctccagcagcctcagcgggaagcgcgcagcgccggcgaggagcggcggagaggtggccgaccacaccccgagagccggaggcggcagcgacgacgaggactccggcggtgggtcgcgcaagaagctccgcctgtccaaggaccaggccgccgtcctcgaggagagcttcaaggagcataacacactcaaccccaagcagaaggcggcgctggcgaagcagctgaacctgaagccgcgtcaggtggaggtgtggttccagaaccgcagagccaggacgaagctgaagcagacggaggtggactgcgagttcctgaagcgctgctgcgagacgctgacggaggagaaccggcggctgcagcgggaggtggcggagctgcgcgtgctcaagctcgtggcgccgcaccactacgcgcgcatgccgccgcccaccacgctcaccatgtgcccctcctgcgagcgcctcgcctccgcgtccgcgtccgccgaccaggcgggccgtgcagggccctgctggggccctctccccgtgttcgtcgacggcccagcccggaggccgtga

SEQ ID NO: 2055 - DNA, 425 bp, Oryza sativa
cattatgtggcgcggcccgattcgtcccgagcaggccatattttcattataaatagcgcgaaatgtaagcggtaacgcatcatcgatcatcggtaggaaggaagctaggaagaaagaggaagaagaggggccttgcatgagggctagagcctgcctctggtagccaaggatgacttgcctattgtgctcttctgaatgatgcagtgccatgatcagtgtggcctggctggttcagatgagccgagataggcagtctccttggctagcctgagtggctcttgtctgtcatggaaggcttctgcttctcattgattcagtgctgttctcaagtgatctgtacacctaatgtgcatgcacacaggttaatggtgatccttatatgtgtgatactgcaatcttgtgttgtgttggtcattgttgcaact

SEQ ID NO: 2056 - DNA, 673 bp, Artificial sequence
  Synthetic construct
aattcatctatcccccgctctctccatctctctaccctttctctctctcggatagctagctcttcttcttcctccttcctccgtttggatcagacgagagggtatgtagtggtgcaccacgagttggtgaagctgccagcatgatctggttctgatggtggtggtatatgtaagatggatgtaatctatactacggcccctgttaatttctctctctctccccggtccctgactgtcatatatggatcgacgaatccaagatgagaggggaatggagagagagagagagggtaattatgagcaccaggaccaggtcatgctgtagtttcatctgctggtggccgcacatcgaaaaccctagctagctctagtagctagctcatcctcgtgcaattcatatccatgctgcactcgccagaccaccagtcaagctagcttatttccgccgttgacgacgttgattaattattcgtgataataatagccttgtcgatctagtttcgtctctctctttttattattatgcctttgcttctctcttggttcggttgtgtattgctgtcttggtcatcactgtgtgcctacatacgatttcactgtgtgatccttcctgctcacgataatgcagatggtgggaagctgtgcattgccggaagtcttcttttcgaaggtc

SEQ ID NO: 2057 - DNA, 568 bp, Artificial sequence
  Synthetic construct
ggcagagccgtgcccgtctcatcccctgcccgtgcaagcagctaggtaggacgatttgagcgtggtgttaggccgaaccgctgaaggaagattgctccactgttgactgcatttcaccagcactaaccagatcaaatgtattgcttatattcagcaatataatgttcgatctggttggcgctggtgaaatatagtcgatagtggaagaacggtaacatatgtggtttgcagcaggtgagcaggatgggtgtggatgattgaatatctctgttcagtgttttcatcatctgactgaacactgaatcagcttgctgacgttagaggtttcagtttacctaatttatggtctgtacccatgaaaagtgggaaaaggctgaagaattcgatttctttctttctttcaatgttgagcacagctacacaggcatccaacccaacatcatgttgttcaacatgatatttgtctgcctatgcaagaagaccagggctttggaagcctaaaaagtcttcgaccagataggatcttagggtatgaaacccgacgcgttctcgtgtgctgcatattgtt

SEQ ID NO: 2058 - DNA, 1055 bp, Zea mays
gctgcgcctctagcctagtaggctctctgcctcccatcattcgattcctttgcacttgctgtgctggctttgcttgctcttgctctcccctcgccagcaataagctcggccccattccgcttctgccatcaagcccttgccgcgcgcgcacccgcgcactacgtataaccagctagagtagcttggtagctaggctcggctcgctagcgagctcgtcgatccaatccatcgctcgttcgtccactataacaatcgacgacgtgtacgatggcagctgcggcggcgccgaggcccaagtcgccgcctgcctcgccggacccctgcggccgccaccgcctccagctcgccgtcgacgcgctccaccgggagatcggcttcctcgagggcgaaataagttccatcgagggggtccacgctgcctccagatgctgcaaagaggttgatgagttcgttggaaggaacccggatccgttcctaacgattcagcaagagagaggaagccacgatcaatctcagcagtttctgaagaagttccgaggaaagagctgcctgagctactacctctcgtggatctgcggtggcgggtggtggtgcccgccgccgttgcagctcaagaggccaccggcgccgagctgctcctgcgcgccgcggctggggaagctctgctcctccaccgcctcctcctgctgcagctgttgctgctgccggttccgcgtcgtgtacgccgccgccggctgcgggtgctgcgcgccgtgcccgcgctgctcgtgcgactgcacctgcgcctgcccgcgctgctgctcctgcgcctgccccatgtgcagcgccgcgtgctgcgccccgcgctgctgcctgtgcctatgatggccatgagaaattttgcgtgcatgctagtagtagtagtacctggagatgatgatggatgactggcattttgcagcatggttttttttttgtttagtttcggcgacacgagtactgttgtaactggctgtacgtggctgatctggttagtgctggtgaatggtgtcgattccgcaaaaaaaaaaaaaaaa

SEQ ID NO: 2059 - DNA, 21 bp, Artificial sequence
  Synthetic construct
tctcttaccactcctctgctg

SEQ ID NO: 2060 - DNA, 21 bp, Artificial sequence
  Synthetic construct
tctcagcgaaaggcagcggtc

SEQ ID NO: 2061 - DNA, 21 bp, Artificial sequence
  Synthetic construct
ttgttcccgcctccgcacccg

SEQ ID NO: 2062 - DNA, 1912 bp, Zea mays
gaggaaaaacttttttgaaaacaaaaaaccccccactcccacgtcccaccacctcgcctcggccgctgcgacagtgcatacgccccctcccctcctgactcctgttgcgtatacaccgtatgtgtctactgtgactccgggtcccgggggggtaagcgaccgagcaaggcttcgtctccggcggcggaggcggatctgggagggatggggaaccggataggcgggcggcgcaagtcgggggtggaggagcggttcacgcggccgcagggtctctacgaccacaaggacatcgaccagaagaagctgcgcaagctcatcctcgaggccaagctcgcgccctgctacccgggcgccgacgacgccgcgcccggcggaggggacctcgaggagtgccccatctgcttcctgtactacccaagcctcaaccgttcaaagtgttgctcaaaggggatatgtacagagtgttttcttcaaatgaaaccaactcatactgctcgacctacacagtgcccattctgcaaaacgcctaattatgctgtggagtatcgtggtgtgaaaacaaaggaggaaaggagcatagagcagtttgaagaacagaaagtcatagaagcacagttgaggatgcgccaaaaagaactccaagatgaagaagctaaaatgagaagaaaacagggcaggtgttcttctagcagaacggtaacaccaacaacagaagttgagtatcgagatatttgcagcacatccttttcagtgccatcatatcaatgtactgagcaaggaaatgaatgctgttcatctgaaccttcatgctctagccaggctaacaggcggcctttccattctagacacaaccgtgatgataatgttgacatgaatctggagaacatgatggttatggaagcaatttggcgttccattcagcaggaacaaggacatctagtaaatcctgtttgtggcagctactttcctgtaattgagccaccatcacgtgaaaggcaggcatttcttccggctgctcctctagaaatgcctcatccaggtggatactcttgtgttgcggctttggctgagcaccagccaccaagcatggatttctcttacatggctggcagtagcacatacccagtctttgacatgatccgccgaccgtgcaacatgtctagtggaagcttgtgcagcgtcgagaacagttcactagacacctggagcgggatggcaccaaattgcagcagaggagtggtaagagaggagggagagtgctcaaccgaccactggtcggagggtgcggaggcgggaacaagctatgccggatcggacatcatggtggatgcaggggccatgcaaccgctgcctttcgctgagaatttcaccatggctccaagccacttccgcccggagagcatcgaggagcagatgatgttttccatggccgtgtcactagcagaaggtcatcatggtaggacgcaagcgcaaggtctggcatggttgtaagttgtataacactaattttgacgccttgatccctgcccctttctgttggttcgacctgcttcccctgcacctctgcttttttgccactttgtttagctttttgctccttttttttcttttctttcttttttgcatgtgtttcttcatggcttgatatagatcttgctatagtcctccattgtcattgcttatatgtatgtaaaatggaatatgtggaaataggaaagaaaatgggtcgaaagttcttttgccggtaggatgcccagtgtgttttcgcattgcaaagcattccaagattttgcaaagttgacctggaacaggcattttagctattttttccgttgacatgttcttggggtgtaaaaatgtttgattttatgggaaaaaacaactagactctgggccggctgaggttaatttc

SEQ ID NO: 2063 - DNA, 568 bp, Artificial sequence
  Synthetic construct
ggcagagccgtgcccgtctcatcccctgcccgtgcaagcagctaggtaggacgatttgagcgtggtgttaggccgaaccgctgaaggaagattgctccactgttgactgcattttaagcatcccatcctgatgaaatgtattgcttatattcagcaatataatgttccatcaggataacatgcttgaaatatagtcgatagtggaagaacggtaacatatgtggtttgcagcaggtgagcaggatgggtgtggatgattgaatatctctgttcagtgttttcatcatctgactgaacactgaatcagcttgctgacgttagaggtttcagtttacctaatttatggtctgtacccatgaaaagtgggaaaaggctgaagaattcgatttctttctttctttcaatgttgagcacagctacacaggcatccaacccaacatcatgttgttcaacatgatatttgtctgcctatgcaagaagaccagggctttggaagcctaaaaagtcttcgaccagataggatcttagggtatgaaacccgacgcgttctcgtgtgctgcatattgtt

SEQ ID NO: 2064 - DNA, 1881 bp, Zea mays
atggcgtcctcgctgctctcctcccccgctaaacccaccatcaccaccaccaccaaaacgaccccggccccaagacccgcccgctccgcccatgtccatgtcctctccgccgcccgctgcctccgcctccgcctccgcgcgtcgtcgcagcatcctccgcctccgcccaccccgcggtcgcggcggccggattacgtcccgaaccgcatcgacgaccccaactacgtgcgcatcttcgacaccacgctgcgcgacggggagcagtcgccgggcgccaccatgacgagcgcccagaagctcgtcgtcgcgcgccagctggcccgcctcggcgtcgacatcatcgaggccgggttcccggcctcctcccccgacgacctcgacgccgtgcgctccatcgccatcgaggtcggcaacccggcgccaggacccgccggggaggaggacgccgtccacgtgccggtcatctgcggcctctcgcggtgcaaccggaaggacatcgacgccgcgtgggaggccgtgcgccacgcgcgccgcccccggatccacaccttcatcgccaccagcgacattcacatgcagcataagctcaggaagacgcccgaccaggtggtcgccattgccagggagatggtggcctacgcccgcagcctcggatgcactgacgtcgagttcagccccgaggacgccggcaggtcaaatagagagttcttgtatcatattctaggggaagtcataaaagctggagctacgactctcaatatcccggacactgtcggatacaatcttccttatgaatttggaaagttgattgctgatataaaggcaaacactcctggaattgaaaaggctatcatttccactcattgtcagaatgaccttggtcttgcgactgccaacacactagcgggcgctcgtgcaggagcacggcagttagaggttactattaatggtattggtgaaagggctggaaatgcttctttggaggaggttgtcatggcaattaaatgccgcagagaactgttagatggtctctatactggaatcgattcccgacatatcactttgacgagcaaaatggtgcaagagcatagtggacttcacgtgcagccacataaagctattgttggtgccaatgcgttcgctcatgaaagtggaattcatcaggatgggatgcttaaatataaaggaacatacgaaattatatcgcctgatgatattggtctaacacgtgcaaatgaatttggtattgttcttgggaaactcagcggaaggcatgctgtgagatctaagctagtagagcttggatatgaaatcggtgacaaggaatttgaggacttctttaaacgctacaaagaggttgcagagaagaaaaagcgcgtaactgatgaagacttagaagcgttattgtcagatgagatattccagcctaaggttatttggtcccttgctgatgtacaggcaacatgtggtacacttgctttatctacggcaacagtgaaattggtagcaccagatggagaggagaaaatagcatgttcagtcggaacaggtccagtcgatgcagcttacaaggctgttgacaaaataatccagattccaacggttctccgagaatacagtatgacatcagtcacagaaggcattgacgcaatcgcgacaactcgggttgttgtcactggagatgtgagcaacaacgccaaacatgccctgactggccagtccttcaaccgctccttcagcgggagcggggcatccatggacattgtggtgtccagtgtcagagcttacctgagcgccctgaacaagatctgcagtttcgctggcgccgtgaaagccagcagcgatgtagctgagaccgcaagcgtcccgagcacagaatga

SEQ ID NO: 2065 - DNA, 11722 bp, Artificial sequence
  Synthetic construct
cgcgcctgcctgcaggtactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagcggaccggtcgcgcctcagcagtcgctgtcgttaacccagcggtactcgctgaggcgatcgcgggcccggtaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgacctgcaggatttaaatccatcgttctggggcctaacgggccaagcttactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagtgatcaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcacggtgcaagcagccggcccgcaaccgcccgcaaatcctctggcctttccggaaccgtccgcattcccggcgacaagtcgatctcccaccggtccttcatgttcggcggtctcgcgagcggtgaaacgcgcatcaccggccttctggaaggcgaggacgtcatcaatacgggcaaggccatgcaggcgatgggcgcccgcatccgtaaggaaggcgacacctggatcatcgatggcgtcggcaatggcggcctcctggcgcctgaggcgccgctcgatttcggcaatgccgccacgggctgccgcctgacgatgggcctcgtcggggtctacgatttcgacagcaccttcatcggcgacgcctcgctcacaaagcgcccgatgggccgcgtgttgaacccgctgcgcgaaatgggcgtgcaggtgaaatcggaagacggtgaccgtcttcccgttaccttgcgcgggccgaagacgccgacgccgatcacctaccgcgtgccgatggcctccgcacaggtgaagtccgccgtgctgctcgccggcctcaacacgcccggcatcacgacggtcatcgagccgatcatgacgcgcgatcatacggaaaagatgctgcagggctttggcgccaaccttaccgtcgagacggatgcggacggcgtgcgcaccatccgcctggaaggccgcggcaagctcaccggccaagtcatcgacgtgccgggcgacccgtcctcgacggccttcccgctggttgcggccctgcttgttccgggctccgacgtcaccatcctcaacgtgctgatgaaccccacccgcaccggcctcatcctgacgctgcaggaaatgggcgccgacatcgaagtcatcaacccgcgccttgccggcggcgaagacgtggcggacctgcgcgttcgctcctccacgctgaagggcgtcacggtgccggaagaccgcgcgccttcgatgatcgacgaatatccgattctcgctgtcgccgccgccttcgcggaaggggcgaccgtgatgaacggtctggaagaactccgcgtcaaggaaagcgaccgcctctcggccgtcgccaatggcctcaagctcaatggcgtggattgcgatgagggcgagacgtcgctcgtcgtgcgtggccgccctgacggcaaggggctcggcaacgcctcgggcgccgccgtcgccacccatctcgatcaccgcatcgccatgagcttcctcgtcatgggcctcgtgtcggaaaaccctgtcacggtggacgatgccacgatgatcgccacgagcttcccggagttcatggacctgatggccgggctgggcgcgaagatcgaactctccgatacgaaggctgcctgatgagctcgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatgggggatccactagtgatatccgtcgactggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgg

SEQ ID NO: 2066 - DNA, 9769 bp, Artificial sequence
  Synthetic construct
ggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggaccaggtggtaccggcgcgcctcagcagtcgctgtcgttaacccagcggtactcgctgaggcgatcgcgggccctgatcacctgtcgtacagtatttctacatttgatgtgtgatttgtgaagaacatcaaacaaaacaagcactggctttaatatgatgataagtattatggtaattaattaattggcaaaaacaacaatgaagctaaaattttatttattgagccttgcggttaatttcttgtgatgatctttttttttattttctaattatatatagtttcctttgctttgaaatgctaaaggtttgagagagttatgctctttttttcttcctctttcttttttaactttatcatacaaattttgaataaaaatgtgagtacattgagctcatttaaataagcttgatggggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcggaggaccgaaggagctaaccgcttttttgcacaacatgggggatcatgtaactcgccttgatcgttgggaaccggagctgaatgaagccataccaaacgacgagcgtgacaccacgatgcctgcagcatctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgacctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgaccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctaggaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgcggccaccactcgagaagcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagttaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcatggagcttcatctaggccagctactgccaggaagtctagcgggctcagtggcaccgtgcgcatccctggcgataaaagtatttcacacaggagcttcatgttcggaggacttgctagtggagagacgagaatcactggtttgcttgagggcgaagatgttatcaacaccggtaaggcgatgcaagcaatgggtgccagaatccgaaaagagggcgatacgtggatcatcgacggtgttggtaacggaggattgctcgctcccgaagcgccacttgactttgggaacgcagctacggggtgccgtcttactatgggactggtaggcgtgtatgactttgactctaccttcatcggtgacgcgagcctcactaagagaccaatgggacgagtgctgaatcccctgagggagatgggtgtccaggtgaaatctgaggatggtgatcgtcttccggttactctgcgaggccccaagacccccacgccaatcacgtacagggttccgatggcgtcagcacaggtcaagtcagcggtactcctggcgggcctcaacacacctggaatcacaaccgtgattgaacccatcatgactagagaccacacggagaagatgttgcagggtttcggcgctaatctaacggtcgaaaccgacgccgacggcgtgaggacaatccgcttggagggcagaggtaaactgactggccaagtcatcgatgtgcctggagatccctcgtccacagcgtttcccctcgtagctgcgttgctcgtccctggatctgatgtgacgatcctgaatgtcctcatgaatccaactagaaccggcctcatcctcacattgcaggagatgggtgctgacatcgaggttatcaatcctaggttggcaggtggagaggatgtggccgatctgcgcgtgcgttctagtacactcaaaggcgtgaccgtccctgaggatcgcgctccatccatgatcgacgagtaccccattctcgccgttgctgctgcgtttgccgagggcgcaactgtaatgaacggccttgaggagttgagggttaaggagagtgacaggctgtccgcggtggcgaatggcctgaagctaaacggcgtggactgcgacgaaggtgaaacgtcccttgtagtccgtggtcgcccagacgggaaggggttggggaatgcttcgggagctgctgtggcgacgcaccttgatcatagaatcgccatgtcatttctggtgatgggacttgtctccgagaatccggtgaccgttgacgatgctaccatgatcgccacctcctttcctgagttcatggacctcatggcaggcttgggggccaagatcgagctgtctgatactaaggccgcttgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcccacgtgcggaccgcctgcaggccgcgttatcaagctaactgca

SEQ ID NO: 2067 - DNA, 8504 bp, Artificial sequence
  Synthetic construct
aggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatccccatcaagcttggccagcttctgcaggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacagaaaaatttgctacattgtttcacaaacttcaaatattattcatttatttgtcagctttcaaactctttgtttcttgtttgttgattagatctggtaccctcagcagtcgctgtgcgatcgccagcggtactcgctgaggtcgacgtagttagttaattcagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgcggccgccactcgagtggaagctagctttccgatcctacctgtcacttcatcaaaaggacagtagaaaaggaaggtggcacctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgatacttccactgacgtaagggatgacgcacaatcccactatccttcgcaagacccttcctctatataaggaagttcatttcatttggagaggacacgctgaaatcaccagtctctctctacaagatcggggatctctagctagacgatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgatccccaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcgggccactcgagtggtggccgcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcg

What is claimed is:

1. A recombinant DNA construct comprising a promoter operable in a plant cell, operably linked to DNA encoding a single-stranded cleavage blocker RNA that binds in vivo to a target RNA transcript in said plant cell, at an miRNA recognition site for an endogenous mature miRNA, and forms, through complementary base-pairing, a hybridized segment of between 19 to 24 nucleotides in length at said miRNA recognition site in said target RNA transcript, wherein said hybridized segment comprises:
   at least one nucleotide in said single-stranded cleavage blocker RNA that does not match through complementary base-pairing with said miRNA recognition site at positions corresponding to positions 10 or 11 of said endogenous mature miRNA;
   and wherein the single-stranded cleavage blocker RNA interferes with the binding of said endogenous mature miRNA to said target RNA transcript at said miRNA recognition site.

2. The recombinant DNA construct of claim 1, wherein formation of said hybridized segment inhibits cleavage of said target RNA transcript mediated by said endogenous mature miRNA.

3. A method of modulating expression of a target gene in a plant cell, comprising expressing in said plant cell the recombinant DNA construct of claim 1, wherein said target gene encodes said, target RNA transcript.

4. The method of claim 3, wherein formation of said hybridized segment inhibits suppression of said at least one target gene by said endogenous mature miRNA.

5. A non-natural plant chromosome or plastid comprising the recombinant DNA construct of claim 1.

6. A non-natural transgenic plant cell having in its genome the recombinant DNA construct of claim 1, or a non-natural transgenic plant or a non-natural transgenic plant seed or a non-natural transgenic pollen grain each comprising said non-natural transgenic plant cell.

7. A non-natural partially transgenic plant, wherein:
   a. said non-natural partially transgenic plant comprises the non-natural transgenic plant cell of claim 6 and further comprises non-transgenic tissue; or
   b. said non-natural partially transgenic plant comprises a transgenic rootstock comprising the non-natural transgenic plant cell of claim 6 and further comprises a non-transgenic scion.

* * * * *